United States Patent 7,745,391 (HUMAN THROMBOSPONDIN POLYPEPTIDE) - sequence listing, part 153

SEQ ID NO: 399913 - DNA, 352 bp, Homo sapiens
gaggccagagagtcagtccctggtagggccctgtgcactttcctcttcctgtgaaatggggccatgaccctgacatttccccacgaggcactgagcaggagaaccaggcaaacctgagtgggagaactgacagcacgctgcccccggccctgagcaccaaacctctccccgcttctggccaggctcgcttgaaggctccctcccccaggaggtcacctggcaggaagtaaactccagggttctttttttttccccccgagacaaaatctcactctgttgcccaggctggagtttgcagtgagccaagatcacgccactgcactccagcctgggcgacagagcaagactctcg

SEQ ID NO: 399914 - DNA, 664 bp, Homo sapiens
atttccagtttcctatctcagtaacaactccttaagaaatgatgcaacagaattaagcagtaatgagctggtgattcccgtgcacactttaaaagcactagtgtgtgtttcagaattctgtcagccatagcagatagcagccaaagcagtccaaaaaaacgtgactttgaaaatgtggttgttagatcacagtacttaaagtggttttagacaatttacagtgattcccttagaatttctgtggaaatcagtgtatctctattccaattctttcagttctgcaaaagcatcagaaacccctgtgtggaaggtgtgtgggtggaggttctgcaagcacctttcatcctgagggagggctgactttcctaccacaggctggctacgcacatgatctgcttcagagacacggtttttgaattgcaagagtgacagaagaccagatttgtttttaaaactgggaagtaaattacagatgatctgatacaaactcctaattttataagaaaataaatgatgaccaagatgcttaaattatttacttaataacacttcgttaatgacatagcttagattataacctatatcttcagttcctgaaacaacgttctttcttactatgccatgctactgtaagttatttagtgcagacttaaaaaaaaaaaaa

SEQ ID NO: 399915 - DNA, 290 bp, Homo sapiens
aattaacagataattaatatatatatttgcacatatgaaaatatgtttaaattctgtaataaaaaattgcaaattgaaactatatgaagatactgtttctctgctatcagcttggtaaaaatttaaaaagtatgtcagtgcatacaggaacaggtagtgtcattgatttctggtaaggaagcacattgttatcaatataatctttatgaaggggaatttgactatgtctaacaaaattatatatacattaatcatttcacccaaaaatcccaagtctaacaatttaccct

SEQ ID NO: 399916 - DNA, 494 bp, Homo sapiens
agtgaagtggcgtgaactcagctcactgcaacctcggcctccccgggttcaagcaattctctgcctcagcctcccgagtagctgggattacaggcgcccaccaccatgcccggctaatttttttgtatttttagtagagacgggtttcaccatcttggccacgctggtcttgaactcctgacctcgtgaccacctgcctcggcctcccaaagtgctgggatgacaggcgtgagccatcccacccggtctgccacagtcattcttttttatgctcagacagtcacaactttggccattcaagaccctttcataccggatcttatgttcttataacacgacctgatgaatctttaaaagcgaccttgctttcctggtacaaggcgccccacattcactcccaccttccctgccccaggcctggaaccagccacttctccaaggagccttggctcctttttagtggagaatgatacttggaaactaaaatctaggta

SEQ ID NO: 399917 - DNA, 364 bp, Homo sapiens
tcagctttatatcccaggcacctggaaaatacttggcacattgaggctgttcaaaaattatttcaagaatggatgaacaaaatgacctgggctgtaagcctaatcctgcttctcatttgctgtgtgacccggacaaatgccaacccatatcttttctggaattccatggtcctcttgtatggaactaggggattggggttgtctctgaagatctatccagctttagaatccactaagtacagtggagagagggttatgccaggtgtgtttgatgactctatctgcccagggtatgtggtatggcaagtgaacttgaaacccttggcatggaagtaggagacaagacatataagccagtgatagg

SEQ ID NO: 399918 - DNA, 333 bp, Homo sapiens
ccctgtcactcaggaaattgggaggtcagtgacaggaactgggaacaaagacctaatatatgtttttattataccgcagacttaaacatctgacatggtagactggatggtttgtttcccaagataaactgagaaacatacaacccaggtatcaaaaaggaaaattgtgggtgtggtggtgtacacctgtggtcccagttacttgggaggctgaggcagaaagattgcttgagcccaagaattcaaggctgcagtgagctattatcataccactgtgcttcagcctgggtgacagagtgagactctgtctctgaaaaagaaaagaagttattt

SEQ ID NO: 399919 - DNA, 225 bp, Homo sapiens
ccattgctttaattttacttcttgaaaaaaattttcaactaaaagtcatgtgcaactaatgtcatcaaaacctcactttaacacattaattcaatgctagtgaatatgaccattcggtattccaataaacacaaaatgcgtgaatttcattaacatatgcctggaataaccagtttctatgaaacctgtaatgcgatcctttcatttctgtccattttaactgcc

SEQ ID NO: 399920 - DNA, 496 bp, Homo sapiens
ctgctccatccacactatgccagtctcgttcatgttccttgaacatgccaggcaggctcttgccttcgtgtcttgcactagttgtacctgtgtctgaaaggctctttacccagatatcccttgccttcttcaagcatcggctcagctccctccttagggaggcctcctgcaataaattgaatgtttgtatccccccagaattcacgtgttgaaaccctaattcccaaagtgatggtatttggaggtgggatctctgggaagtaattaggtcacgagagggaagcccttatgatgggcttagtacccttctaagaagagacaggagagagcttgcttcttctatctaccctgtcaatatacactaccacacccttctgcaaaccaggaagtggaccttcttcaccaggaccggaattggccggccccttgaccttggacttcccagcatacagaactctgagaaataaacatttgttgtctaagccaaaaagtctat

SEQ ID NO: 399921 - DNA, 1128 bp, Homo sapiens
gtgtgattagttgtgtgtttcatgtcaggcaggatcaagtatttcttaagttaaattagacactttggattggatgccatcaagagggttgggtatcattctggactctgactcaggacttttatatttactgcaagatttatgtcaccagatggcaccatttaactaaatttatgtgctttagatgagtatgaggctggttgtttctaaatgaaggatgctattatttgtgctgtagctaatataggaaaaaaatcttttattttgagtgcatatgagatttccctatatagtgagatagtgaaaccccaaagctattgttgggagtgtgaaaggatctggtgatttctgttaagtacataataagtgaaaatttggtgatgatcactgtaactaatatgtggtagctggcaaaaaagcaataggctttctcatctaggttttcctatagcaagcaaactagtattattaatattatagccttgaattttactttttgttgttgaactactttcagggaatttatatatatatatatagagagagagagagagagaatataaaaaaaattctaaaagattattttaggaataagccctttcaagatgtcctgaaatagcgtagtaatatctaaaaaaatttttcaatatagaatatgttttactgaactgtggaactaatcaagttaatagaatgtgatatagacattatttcttagtataaacatccatcccaaggaaatgagtatttattacttggtcaaaaacttcttaatattttctacctttaagcagaattaatcacttcttcccttatgtttctatggtatttgtttatatttctggcacagcacttattatattgtactattgtttattgattacatgttgctctccctcagcagactgtgagcttcttgaatgcagggaccagttctaattcagccaaatctggcatggaatgaacagttcttcattaaatttctttcatttgaaaaaatacatttgatctcccactatcaaagagacaccacattaggctctggggttttagtgatgagagagatgtacaccttgttttcatggagctcattgtctactacattaaacaagtaagatattaaataag

SEQ ID NO: 399922 - DNA, 1186 bp, Homo sapiens
tgtctctgtgctcatgacaaggacatatcacctaactctgggctctggctcacttagtagcttctttgccgttggactctcacaccgagatgtcaccgagcagcagcctttcccaggaagttgttaaggagatgggaatcctcatgcctgctgctttttcccaaatcagaggaagcccgggagccagttgcagtaaagtcttgccagtaacgtttctcttaagaacgagaaagctactcaaagaaatgatctcttcctggatgttgtggtccacgaatattatgtctggaacatcagagccatcttgtctccatgatgggagttccatctaaagacaaagtcaaaacccagcagaggacacagctgaaggaacacgagaaagtggcatggaaacgctgaagccccagcaccggcagacctcagttattggggccaatcaacctcttgttactgttcaagcgagtttggaaacgttgtcagagacccacaacagaaaacaactcaaacagcaagggagatgtgcccctactggccagtgaaggaggaaatggctgtgaatgtggaatcagaaatctggattggaacctgagctcagccttttactggccatgggatcttgaacaagttactcaactgaactgaatgtcaatttcctaatcaacaagacagtaaaatcatgcctactctgcagggttattataaagagtaaaatcagcttgtgtctgagacagggtagatgctcagtaatgttagtagtatctttattatttcatggaaatgaataattttcctgctttaattgtttgaaaaaagatagtgtttaccaaaaaatgtgtttttttagtcaataatttcaaccacagttttaattactgacaaaatgaaatattaggttccaatacacttcttaaaaatattttaaaaatcttcagtatttagtaaatcccagcaaaagaggcaaaatgtggttgatgggaaatccttgaacggggtagaggaacaacatcaaggaaatccaggatggagtttggagcagcatgatctctcagctgtggcctgatttctgctggtatttcttgaaaaacagggtcaaaaagggagcatattgtagctaaccagagtagaactctcttgaatcaatgactcccagatggaaaaaagatcaataaaacactctaaatgcaaa

SEQ ID NO: 399923 - DNA, 432 bp, Homo sapiens
cagctggtcacaaattccctggcctcaggctactgccttggtctccccacggtgctggaattacaggcataagggcattgtgcctggccaagagttttttaaaatctatttgcattacttttataattagaattaatgtttaaaaagtcaatctaaagtaaaatggtgaattaagactccatcccaaaaaaaagatgtgtctagtgtgaataagaattttaatttgttactttattagattgtaattaatttacaattaaataatacaaatatataaaaattagctgggtttggtggcacatacctgtaatcccagctactcaggaggttgaggcaggagaattgcttgaaccccaggagaacagaggttgcagtgagccgcgattgcaccactgtactccagcctgagtgacagagcaagacttcacctcg

SEQ ID NO: 399924 - DNA, 417 bp, Homo sapiens
tggtcagcatctactttttaccatggctctgtgagagtaacacacatgattccttaaatacagttaaatacacaaatacagttaaaaacagttaaatacaggaatacagttaaaacagttaaatacagttaaaaacagttaaatacacaaatacagttaaatacagtcaaatacagaaatatagctaaatacagttaaatacagaactattttcttgagggtaataaaaagttaaccaaagaggcagtgcataatgaaggccaaatgagtgtgtctagacagtaaacatttatttcagaagaggtacctaataagtattcaataaatattcgatgaaagaataaatgggcgagagaaagctcagtgtgggctaaagcagttgggaacacagtactgaacacagcctgaccaaagcac

SEQ ID NO: 399925 - DNA, 480 bp, Homo sapiens
catatatttgaaaaatatattaataataacatgtgcaattaattgtacagagtaggctactatggctgtagcccattcaaaactctcttcataattctctggtgattttcaccatctatcttccatatcaaagaactgatattcaagtcactgtttgagttttgatcggctttatttcaaagactgtaagcagatacacttaaaataggccaagcagaaaggtaacttgggatactgtttttaaccacaaaatatgaaatcttaatgcaccagtaggtgatttaagagttaataggctaaaaaatgaagaagaaacaagagaattagaatatcctcacttttcagcccttaatgaattaaggaatctaggcaatgttcatcaactaccactaatggcacaaatagtcagatatgtgtgtgtcctgataaagcagtgttaatccagtcaaccagtaacaaaaaaatcctaaatttgaaaaa

SEQ ID NO: 399926 - DNA, 406 bp, Homo sapiens
gattctaattacgctcgagcagaaagtaatactttacagggctgggtaaaaacactcattcggaagtaaagttggggggtcataaaaactggggattactttagttagtcatttgtaacaggtaaaagttgtgttttaacttcctggagttgggcgggggaggcagaaggggctattttaggaggaaggagagtccagttaacaaaaggaaggtccttatgaatttttccagggctgcaaattcataaataacaacagtatttattgtaagaaggacagaacttgaggattaacctttccacacatctgtacttaacccattgccccagtaaaagagagcccattgtttgttcagtgtgtcaatcattattatagaaaatgcacacacatctcacccaaaagttgg

SEQ ID NO: 399927 - DNA, 381 bp, Homo sapiens
agagagaaaagtctggaaagacatatgccaaaatgttaacacctgggtgacagagcgagactccatctcaaaaaaaaaaaaaaaaaaaaaagaggccaggcatggtggctcacgcctataatcccagcgctttgggattttctgtctcaaaaaaaaaaagagagagactctggatcaaaaaggattttcacaaacagatccaaagaaccagcatccagattaagaaacagcattaacagcaacccagaagcaacccttgggacctgcctcaatctctgcctcctccctactccccataggtaacctctatcctgacctcttaacaccatggatcagtgaagctccttttaaaagtatataaatggagtcatgtagatttga

SEQ ID NO: 399928 - DNA, 546 bp, Homo sapiens
agggtaatgctgagcagacagaacaacagatggacattagacaggtccattagtgctgactctataggagagaggaagcattttgaactcccttcagttttgccaactgaataggccacagatcctgctatagttacaggcctccactagctcattcattagtgccaggtccatcttattatttgctaaaatatcccttcacctctgtgtagatagaattggtatctcacttgcagacactcttgtgtttacaaactgtgggttacaacacattagtgagtgatgaagttggtttagtgagttacaaacaacatcaaaaaaatagaacagcagataattgaagagaaagtatcatctgtaaggggaagtactattacttcataaagttgtttataaagttgtaaaaagtttacttcataaagttgtaaaactaaatatagtatatatatgataaaggaataccaggtcattctgggtttgcaatatgacatattttcttgcttggattatggtaaaaaataaagacagtctgacatatactataga

SEQ ID NO: 399929 - DNA, 279 bp, Homo sapiens
gcatgagccactgcatcccacctaaatccatccttcttggccctggcctttgatgacccctgcagcctcacttccaaacactctcagcccattctaaccccaacttcatcttgcagccacactgaatactgagcaggccctgtgctttctaacctctggccttcacacatgctgttccctttgtggagaacactcttcccttgtgtaactatttgtccctcaagtctcaacacaggttgccccctctgtcaggaagccttccttgattccacagcctcc

SEQ ID NO: 399930 - DNA, 323 bp, Homo sapiens
ctcatatcttggtggaaatttaaatttgtataagttctttggaggacaatttgacaatctcttcaaaattacaaatatgcataccttttgacccaactattccacttctaggaacacacacttgtaagttactcactatgccattattctcggaggaaacgtttggaaacaaccaaagtactcatcaggaggggaatgtaggcctggcatgatggctcacacctgttaccataggactttgggaggccaaggtggaaggatcacttgaggccaggagtttgaaaccagtctggacaacatagtaagacctcatctctacaaag

SEQ ID NO: 399931 - DNA, 476 bp, Homo sapiens
gaactaattgggaaagaaaggagtaactctctttattcacagacaaaatgatgatctatgtagtaaatctgaaggcaggtaaaaaaagctactggaatttgagtttagcaaggttgctgcacacaagatcaatataaaaaaatcaaatgatatttgtgcatttagtcacatgagaaaattaaatttaaaaatacgtattagcattaaaaatattatacacttaagggcaactctagcaaaagcatgaaagacttatacagcgaaaactataaaatattgctgagaaaaattaaagaagatgtaaaataataaagtgagatgccacaaaaaagggtcaacagacttaatactgttaagatatcaatgctcccccagtagacctacaaattagaaaaatcccaataaaaatttcagcaggttgtttttttgttgttggtttttttcgggttttttggtagaaatcgacaagtggattc

SEQ ID NO: 399932 - DNA, 429 bp, Homo sapiens
tgtcacagagtctttccacatgctgttggctggaacaagtggtttaaccccatctccttcataaccaaagatgaagaaggtgcgagctacaaggagttagcattcacctctgccacccaggagggcttcctaggggaggggaggtggttaccatactggaggaaaaagacaaggtcaaatgaggtaaaacaggcaacacgcttggaatgaaagagctcaccagaatgttatggccaaaagaacttgaaaataggctggctgcggtgtcgcgcctcggcctcccaaggtgctgggattacaggcgtgagccactgcgtccggccaaccttgggtgagttttataaacgcggcaccttggggcaattttcagtagtcacaatctaaataactgttgtgtttcctgtgtcatagcatagggatttagtgcat

SEQ ID NO: 399933 - DNA, 329 bp, Homo sapiens
gagacggagtctcactctgtcgcccaggctggagtgcagtggcgccatcttggctcactgtaacctccacgtcctgggttcaagtgattctcctctctcagcctcccacaggtgcccagcaccacgcctggctaatttttgtatttttatcagagacagggtttcgccatgttgggcaggctggtctcgactcctggtctcaagtgatccgcccacctgggcccctcaaagtgctgggattacaggtgtgagccactgcacctgacccaaacacattttaaagcagaaataaatcccaaatgcagaaatattataaatgcttagaaagg

SEQ ID NO: 399934 - DNA, 517 bp, Homo sapiens
caagaagggtggagccttcctggaaatgttctatattttttatttcagtggtagttacatgaacatatagattacataaaaattgaatgtatataatgtaaaaatatatattttaaattgtctatatatttacttatgtactttactgtaagtgtctctattaaagaaaaaataaaaccccaaaaaacccagcttatgcctggccccacccagagagatactgatttaattggtctggtgtggggcctgggcatcagcaatttaagagctccttaagtgattctgctatgcagccagggttgagaactactgctctatgtggaaaggctgaggagggaagaaatggtgtgtaaagaaggatcataaaaagcaggagtttcacttctcttttatttttaaaaattttaattaaaaatttttttattattattttttactgctccctgtgcagcagggctaccccataagcagtatgcccagagtagtcaggagtttcacttctaatatgaagttatag

SEQ ID NO: 399935 - DNA, 2959 bp, Homo sapiens
  misc_feature (174)..(174): n is a, c, g, or t
  misc_feature (242)..(242): n is a, c, g, or t
  misc_feature (254)..(254): n is a, c, g, or t
  misc_feature (393)..(393): n is a, c, g, or t
  misc_feature (752)..(752): n is a, c, g, or t
  misc_feature (1325)..(1325): n is a, c, g, or t
  misc_feature (1970)..(1970): n is a, c, g, or t
  misc_feature (2072)..(2072): n is a, c, g, or t
  misc_feature (2660)..(2660): n is a, c, g, or t
gaaacaacatggcaattgggctgtggaattctgtattggttgtaagaatggtccaacaccccatttctaattctttccctgagatcgtggttatcacaccttctaagaggaactacaaccaaacgaaggagcccatgtggcttctgtttgaaaggtcaccagagtcagattcanctggtttaggacattccagtggctataggacactatctactgtgacgcgtaccgtgtgagctcagctntagagtgtttcncagacactgtgtttcctgatcctcacgatacccccgtgagagctgccctaaaagcagagaggcagcgtgatggagaggttcagcacatgctctctgatcccaggaatcctgggtatggtgtttcgtatctgtgtgaccncaggtgagttccaggaaatctatgtgccataatctcctcatgtaaaatgaagttataatgccccatttcctgaagttatgtggattagatgagttaatgacacctggcacatgcaagtcctccacagtatcggcacgcactgttggtgctctagagacagtaataaaccaaaaagtgtctgacacaggcctcaatcaacttagaagtttattttgcctagtctaagggcatgatcagaagaaaataacatggaatcacagaaacagtctatggtctacacctttctccaaagatgaaattgagggcctcaatgtttaaaaaaggaaagtgggctggaggggagagagggagggtataantatccacatgttgcaagagcaagggagcaggtaggggaactgccaattatgtattcatgttgcgctcaataaatcagcactttacataagatatggttaacatagagtagctacctctggagctatttcacctttcatctgtagctctctgtttaggcacaaaaggaaaggcagcttctcacatgacccagcttttggcttatttttttctaaaacatagcatgatgaattgggatccagagtttttcttttcctttcacatagtagattccacacatatgcaaaagcactaacagttatctctactctcacctctccgcagagaggttaggtggtgggaatagggacccagtgagtgtctactatgcactaggcatccgaaatccttgatgagccagttgaggtcagtacaattaaggctcacagttcacagatgagaaagattaaattacctactcaaggtcactatttttaaagtaatagtcgtaatttaaagctaggtccctctgaacccagagcccatatatttaaacacacacacacacacacacacacatttatccaacatcacgnctttcctttcaccgactttcaactggggaaaacaaaacaaaacatgcgttgtttctttactaaaggcatcctcaccagagtcaatgagaattttcttaaggaaataatggtgcacctgtgttttctccttatctacactccaggccactggtttgtcactaatttcccatttgttttttctctttgggtaaaattggcctactctggaattaccattattgcttccttggctgtaaagagtatagaaattctacccctgtgagtgtgtgtcctagatctgcagctgctctttttgggggtgctaatggactgtaaatttcagacacagcaggacggttcatggtgctctctgggtatgtataacattctgacaccccagctccttccagagactaaacaggctcagagctctgcagaatcaccttggaggagattctggaacacccacgtgcatttctgaggtaggaggtagaagaaggttatgcattgttcttggtccagtacgtttccaccatggcacagctaccacatatcgggaggtcacatggtgtgggaggaatactagtcacacttcacagctagttagagccctggccacttggtctggctctaacaagctgtaccatttgttcttttcttttcctntttttgagaaggagtctcattctgttgcctaggccggagtgcagtgacatgatcttggctcactgcaatctccacctccaggttcaagtgattctcctgccncagcttcccaagtagctgggattataggtgcccaccaccacactcagctaacctcagtcctgccttcaggcgatccgcccaactcggcctcccaaagtgctgggattacaggcttcagccaccatgaccggccacaatttgttcttaaccatcccacattgcctaagttcatctgtctttagaagaatgtgtttagattaaataatttcagatttctacctaaagttacaaattcagtgattaccaccctgaggaagtaatgatagcaatcacaaatacagtgcccaccatgtacccggtcctggcttaaggacgtgttcactcatttaattctcacaaaaattctatatgtacaattatctctgttctatggatggggaaactgaggcagagggggctaaagaactttcgcataatcaaacagctactaagaaacagggctggaatttgaactcaagcagccaggctccaggacctccgctcttaccttctatgttatttcctcttagagtgaaaacaggttacttgtagtttcaattaacacatgaaaatgtccttccttattaggctatgaagtaggaaggaaantgcctctttggctgttcacatttcccctccttgctccaatgctgttcagataattagagggttataagccaacctgccaatttgtcaatgctgggaagacttttatatgctgagctcccatccatcatataggacttctgtgattaaagaccgaagcacatggttggacaaaataagtaccagaacaggcagtgcccacaggtgtgcaatggaaaaattaggcaaagatttatacagttctacacaaaaacacgtatctcaatagtcactacagagttagcatactccacacgcttgtc

SEQ ID NO: 399936 - DNA, 416 bp, Homo sapiens
agtatggatggtagggtgttgctgcttaatgattgtattgtttatgtttgggatgaaattagctgtttaattttttcctctcaacttagtcaaaggcaatgtgagaaagcatctagcaataaacagatttacaaaccttttcagatgcaaatcagtgacttagcacatgttactataaagttttaatagaatggaggattgagtttggagcaggaaggccggctagtgacaatcttgcttccttcttttcttaaatactgaaagttaagagtaggaaaaaagtagtctctaaatatcaggataataaagaatttttaaagaatttcttcccataatgggaataattcagaattaaatgtactgtgaaatatataaggatctttatttcttaatgtttttattgctgtatgatcatg

SEQ ID NO: 399937 - DNA, 427 bp, Homo sapiens
cttagcataatttttaactttgatatttcagcaattggtacaattttgaaaacaacacactgacattttattatgacttcagagttataagtaagagagtttagctgatgtgttatctgattacatcttggtatggaggataaacagtaatcttataattccatattacttttacaaatgtcacagctccaagttcaacctgaaatcattaaaaatttgttatctaaaatgtttcttaaaaacaagtgaaaggggaaaataattaacaaaaataaagtgacaatatgtgaagtataatgagagatgtaactatcaatcctgactgctgaacagaaacgtggtatctcagaatattaactagactgatattcagtgtaagccttttagtagaggtgtgcaggcttttctgttataaatgacatcttta

SEQ ID NO: 399938 - DNA, 546 bp, Homo sapiens
tgggaaactatccattctctggcatctggctgccccctgacctcttccaacagggttcctcctcccccatttgactgggtccttggaatgtgctgattcagatatgacaacaggctattcctggaggggtgggggtctcttcttcaggaatgtgcctggagagcccagaaagggcagccaaggggtgctagtctgactgttgcctcagctcaggggtgatgagtggacttctgagtccaagcattgtcccctatgggaatcagagatatgaactgctggatgtatcaagaacccaggcctgccgagcacggtggctcacgcctgtaatcccagcactttgggaggttgaggtgggcagattgcttgagctcaggagtttgagaccagcctgggcaacatggcaagaccccatctctacaaaaaaatacaaaaattagccaagtgtgttggtgtgcggctgtagtcccaggctgaggtgagaggaccgcttgagcctgggaggtagaggttgcagtgagctgagatcctgccactgcactccagcct

SEQ ID NO: 399939 - DNA, 641 bp, Homo sapiens
aacatttctgctgcttttccctgtatgtgtggtgtttagtcttttcatagttcgttgactatggaattcagagcagaaaccctatttcctaatttccttgggaagttttcagaactagatgataatgtaagtttctaataagttgatagtgttactcagaggtgattgtttcatttatgattttgaaaagaaaatgtaaatattagacttaagtccttgcatctaaaacaaattcatgagaaatcccacagaatacaatgttagagatgggagcaaaaattatcagtctaatctcagagagttgacaggcattccaaatcgttttttgtcagtatttaaaccatggtaggataatgtaagaaatatacttaatgcctggtgcgatgtctcacgcctgtaatcccagcactttgggaggcctaggcaggcaattgtctgaggtcaggagttcgagaccagtctggccaacatggtgaaaccccgtctctactaaaaatacaaaaaaaattagccgggcatggtggcgtgtgcctgtaatcccagaatcccagctactcggtaggttgcagcaggggagttgcttggaccagggaggtggaggctgcagtgagctgtgatcatgccactgcattccagcctgg

SEQ ID NO: 399940 - DNA, 983 bp, Homo sapiens
ctggagcggacagggtggcttccgggtttggcgggtactttgtctctcgctctagccggagctgcaggtctcgtcttccctggtctgtgtcctcttctcctaggggcccagcctctgtggccctgtgacctgcaggtattgggagatccccagctaagacgccaggtcctcctggaagcctagaaatgatggagtcttgctctgtcgtcagactggagtgcagtgggatgatctcggctctctgcaacctccgcctcccaggttcaagcaattctcctgcctcagcctcctgagtagctgggattacagggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccaggtaaagagaactggccataaactgtggcccaggaagctggaactgagactttgaactgcttcaggcaccacattaaaagccagggtctgcaggcctgcctgcatggctgtaaacgggtgtcttcctccaggcctgtgaaaggacagaacctctcccagactgcggctgaaaggattttgaaataattacagagtaaattcagaattctcagtgggaccaagtagcgttggccatttcctgtcctgtagccaagaccaggggtcctgtagtttgccaccaaaatgagagcctgctttctgaagagaacacccctcaatctttggctttagcagaatttcacaacttcatccctggactttaaagatctcttaaaggcatttattttggagatggggtcttgctacataacccaggctggtcttgaaatcttggcctgaagcaattctccaac

SEQ ID NO: 399941 - DNA, 769 bp, Homo sapiens
ctggagcggacagggtggcttccgggtttggcgggtactttgtctctcgctctagccggagctgcaggtctcgtcttccctggtctgtgtcctcttctcctaggggcccagcctctgtggccctgtgacctgcaggtattgggagatccccagctaagacgccaggtcctcctggaagcctagaaatgacggagtctcgctctgtcacccaggctggagtgcagtggcatgatttcagctcactgcaacctccgcctcccgggttcacgccattctcctgcctcagcctcccgagtagctgggactacaggcgcccgccaccatgcccggctaatttttggtatttttagtagagtcagggtttcaccgtgttagccaggatggtctcgatcacctgacctcatgatccgcctgccttggcctcccaatatgctgggattataggtatgagccaccgcacctgtcctaaaatttaccatctttaatctgtttaagtgtacatttcaggcctaggcatggtggtggctcacatctataataccaggattttgggagaccaagacagaaggattgcttgagcccaaaatgttgagaccagcctgggcagcatataaagtccccctctctccacacacaaaaaatgttttaatagccaggcatgggggtatgcacctgtggtcctagctatttgggagattgagtggggaggattacttgagcctgggagtttgaggctgcagtgagccatagttgtgccactgcaatccag

SEQ ID NO: 399942 - DNA, 547 bp, Homo sapiens
ctggagcggacagggtggcttccgggtttggcgggtactttgtctctcgctctagccggagctgcaggtctcgtcttccctggtctgtgtcctcttctcctaggggcccagcctctgtggccctgtgacctgcaggtattgggagatccccagctaagacgccaggtcctcctggaagcctagaaatgttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaatcattttgcatgctttcacaactaactcgacataagagaattcat

SEQ ID NO: 399943 - DNA, 563 bp, Homo sapiens
ctggagcggacagggtggcttccgggtttggcgggtactttgtctctcgctctagccggagctgcaggtctcgtcttccctggtctgtgtcctcttctcctaggggcccagcctctgtggccctgtgacctgcaggtattgggagatccccagctaagacgccaggtcctcctggaagcctagaaatgatggagtcttgctctgtcgtcagactggagtgcagtgggatgatctcggctctctgcaacctccgcctcccaggttcaagcaattctcctgcctcagcctcctgagtagctgggattacagcattatttcaagtgcacaaagtgtgcccaaggttgccccttagatgcctgaatccaatgtctgctgaaattgagatgtccaagaattcaagaacacgtccagaaaacctggctgttgtagaaaaaaatataaattagaaatgaaaagctttattcttctaccttgaaataagcacttagcatcttaaagcatttaagatgatatgtacatttatctttgttattttgaaatatacataaattatattaacagct

SEQ ID NO: 399944 - DNA, 2447 bp, Homo sapiens
  misc_feature (647)..(647): n is a, c, g, or t
ctaggggcccagcctctgtggccctgtgacctgcaggtattgggagatccccagctaagacgccaggtcctcctggaagcctagaaatgggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaagcctttaaccagtcctcagcncttactcgacataagatgactcatactggagagaaaccctacaaatgtgaagagtgtggaaaagcttttaaccggtcttcacaccttactcaacataaggtaattcatactagagagaaaccctacaaatgtgaagagtgtggcaaagcctttaaccggtcttcacacattactcaacataagagaattcataatagagagaagcccttcaaatatgatgaatgttgcaaagcctttaagtggtcctcagctcttactacccttactcaacataagagaattcatactggagagaaaccctacaaatgtgaagagtgtggcaaagcctttaaccagtcctcagcccttactcgacataagatgattcatactggagagaaacccttccaatgtgaagagtgtggcaaagcttttaaccggtcttcacaccttactcaacataagataattcatactaaagagaaaccctacaaatgtgaagagtgtggaaaagcctttaaccggtcttcacaccttactaaacataagagaattcatactagagagaaggcctacaaatgtgatgaatattgcaaagcttttaactggtcctcagctcttactacccttactcagcataagataattcatactggagagaaaccctacaaatgtgaagagtgtggcaaagcctttaaccggtcttcataccttattcgacataagataattcatactggagagaaaccctacaaatgtgaagagtgtggcaaagcctttaaccagtcttcacaccttactcaacataaaataattcatactggggagaagccctacaaatgtgaagaatgtggcaaagcctttaaccggtcttcacacctttctcaacataagataattcatactggagagaaaccctacaaatgtgaagaatgtggcaagccttttaatcgtttctcataccttaccgtacataagagaattcatgctggagagaaccccaacaaatatgaagaatgtggcaaagcttgtaaccattcctcaaaccttactaaacataattcataatggagaaaaaccctacaaatgtgaagaatgtgtcaaagcttttaactgttcctcaatccttactaaacataagggaattcataatagagaaaccctacaaatgtgaagaacgtggcctggcttttaacaaatcctcaacatttactaagcataaaataattcatgctggagagaaactcttgaaatgtgatgaatgtggcatagcctcttcccagttctcaactcttactaaacatgagaacactgtggaagataaagcctacaaatatgaagaatgtgacaaggcctttaaaagttctcaacccttattacacataatttatactggacagaaatcctaaagtgtgaagaatgtcacaaagcccttaataagtcctcaattcttaacagatataagatgtttcatactggagcgaaactacaatcctgaatgatgtcacagtgcttttaacaatacctcaaacttttctaaacataaaaaaaattatactagtgcaaaactctagaaatataaagaacatgaaaaacttttaaatggttttcacacttgattgcaggtaaaataatttataccggagaaaactccaagtgtgaagaatataacttttaaccagtgttcacaacttattgtacaggaaagcatttatagttgagaaatggtgtacaaatataaagaatgtggaaaagtcattaatatttgctcacatattacacatcagagagttcatacttaataaaagtattataaataca

SEQ ID NO: 399945 - DNA, 2667 bp, Homo sapiens
  misc_feature (867)..(867): n is a, c, g, or t
ctggagcggacagggtggcttccgggtttggcgggtactttgtctctcgctctagccggagctgcaggtctcgtcttccctggtctgtgtcctcttctcctaggggcccagcctctgtggccctgtgacctgcaggtattgggagatccccagctaagacgccaggtcctcctggaagcctagaaatgatggagtcttgctctgtcgtcagactggagtgcagtgggatgatctcggctctctgcaacctccgcctcccaggttcaagcaattctcctgcctcagcctcctgagtagctgggattacagggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaagcctttaaccagtcctcagcncttactcgacataagatgactcatactggagagaaaccctacaaatgtgaagagtgtggaaaagcttttaaccggtcttcacaccttactcaacataaggtaattcatactagagagaaaccctacaaatgtgaagagtgtggcaaagcctttaaccggtcttcacacattactcaacataagagaattcataatagagagaagcccttcaaatatgatgaatgttgcaaagcctttaagtggtcctcagctcttactacccttactcaacataagagaattcatactggagagaaaccctacaaatgtgaagagtgtggcaaagcctttaaccagtcctcagcccttactcgacataagatgattcatactggagagaaacccttccaatgtgaagagtgtggcaaagcttttaaccggtcttcacaccttactcaacataagataattcatactaaagagaaaccctacaaatgtgaagagtgtggaaaagcctttaaccggtcttcacaccttactaaacataagagaattcatactagagagaaggcctacaaatgtgatgaatattgcaaagcttttaactggtcctcagctcttactacccttactcagcataagataattcatactggagagaaaccctacaaatgtgaagagtgtggcaaagcctttaaccggtcttcataccttattcgacataagataattcatactggagagaaaccctacaaatgtgaagagtgtggcaaagcctttaaccagtcttcacaccttactcaacataaaataattcatactggggagaagccctacaaatgtgaagaatgtggcaaagcctttaaccggtcttcacacctttctcaacataagataattcatactggagagaaaccctacaaatgtgaagaatgtggcaagccttttaatcgtttctcataccttaccgtacataagagaattcatgctggagagaaccccaacaaatatgaagaatgtggcaaagcttgtaaccattcctcaaaccttactaaacataattcataatggagaaaaaccctacaaatgtgaagaatgtgtcaaagcttttaactgttcctcaatccttactaaacataagggaattcataatagagaaaccctacaaatgtgaagaacgtggcctggcttttaacaaatcctcaacatttactaagcataaaataattcatgctggagagaaactcttgaaatgtgatgaatgtggcatagcctcttcccagttctcaactcttactaaacatgagaacactgtggaagataaagcctacaaatatgaagaatgtgacaaggcctttaaaagttctcaacccttattacacataatttatactggacagaaatcctaaagtgtgaagaatgtcacaaagcccttaataagtcctcaattcttaacagatataagatgtttcatactggagcgaaactacaatcctgaatgatgtcacagtgcttttaacaatacctcaaacttttctaaacataaaaaaaattatactagtgcaaaactctagaaatataaagaacatgaaaaacttttaaatggttttcacacttgattgcaggtaaaataatttataccggagaaaactccaagtgtgaagaatataacttttaaccagtgttcacaacttattgtacaggaaagcatttatagttgagaaatggtgtacaaatataaagaatgtggaaaagtcattaatatttgctcacatattacacatcagagagttcatacttaataaaagtattataaataca

SEQ ID NO: 399946 - DNA, 402 bp, Homo sapiens
ttgctctgatcggggtccaacccagggagactgttaggtcctttggtctagaaactagtttgaatatgttttaaggttttattaactttttaataaatagccagactatactgacttgtttgcattgggcatatatactactcttgcgagcaggaggcctgaaatctcctagagaagttcaggcagagggagcctggcaacaagggaaatcccgagattgtaggcaagagggtgaggaaaagatgctttcaaaaagcctggagggagtggagatgattatgtttaacgcattccttctttggttttggtaacctttaacaagtctttctcctccagcccttctcttcaatggtccctgccacctagagctgctagcatagtatggattaatagtgactggta

SEQ ID NO: 399947 - DNA, 989 bp, Homo sapiens
aatatttttttccatgaattctggttgtgtttcatagcagctgtctcttgtttcaatgtgatttactttaaagcaactctgaggatctgaactatgtttaatttcaagtttttatctgtttctattgactattctttttaagtgggctagttctatttgttaaatttggtgctctctttagtgctcttggtttctccaaatgtttgttggttcttttgttgttgttgttccatttgtaggaacagaatttcagtctagactgaaattcatagctggacgcatttcctcacttcaaatgagaactcatgtttacctggcagtgaatgcaggttttgattacaagaatctgcctcatgggatctggtagggataggcagactctgtaggtaacgtctcttcttagaatagtttcctgaccctccagggtattgtccttttcctctgaccttagcttactctggaacagtaatatgttggtaaatgtttgacagccagctctgggtggagtgggggaagtcctagtttgcagcatttcctgatttccatgcaatgtggggagctgagaagagatgtgcaaactagattcttgagactgacttcatttagcataccattgctgtggggctgctgtactatgtcagaaaactatacccatgactctcatctaagcccaaacaatggagccagctgctccaagagcaactccaggaattgatggggacttaggggtatggctccgttatttcttcagttaacaaagtactttgttcctttgaatggttttaggttcttatgccctgctagatttctctactgattcccacgtttcttatttttttcaaaaattcctttctatattgtttgctggaagcaccttttctggttttcctgtgctgctttgaatttatttttctatttctttgtgatttcagtggaatttggagaaggaatggcaaagcggaagtccttctcctatttgatgtcttaac

SEQ ID NO: 399948 - DNA, 1042 bp, Homo sapiens
aatatttttttccatgaattctggttgtgtttcatagcagctgtctcttgtttcaatgtgatttactttaaagcaactctgaggatctgaactatgtttaatttcaagtttttatctgtttctattgactattctttttaagtgggctagttctatttgttaaatttggtgctctctttagtgctcttggtttctccaaatgtttgttggttcttttgttgttgttgttccatttgtaggaacagaatttcagtctagactgaaattcatagctggacgcatttcctcacttcaaatgagaactcatgtttacctggcagtgaatgcaggttttgattacaagaatctgcctcatgggatctggtagggataggcagactctgtaggtaacgtctcttcttagaatagtttcctgaccctccagggtattgtccttttcctctgaccttagcttactctggaacagtaatatgttggtaaatgtttgacagccagctctgggtggagtgggggaagtcctagtttgcagcatttcctgatttccatgcaatgtaaaatctcccaccctagccaattttcaagctagcaacataacagtcactgaatggggagctgagaagagatgtgcaaactagattcttgagactgacttcatttagcataccattgctgtggggctgctgtactatgtcagaaaactatacccatgactctcatctaagcccaaacaatggagccagctgctccaagagcaactccaggaattgatggggacttaggggtatggctccgttatttcttcagttaacaaagtactttgttcctttgaatggttttaggttcttatgccctgctagatttctctactgattcccacgtttcttatttttttcaaaaattcctttctatattgtttgctggaagcaccttttctggttttcctgtgctgctttgaatttatttttctatttctttgtgatttcagtggaatttggagaaggaatggcaaagcggaagtccttctcctatttgatgtcttaac

SEQ ID NO: 399949 - DNA, 1792 bp, Homo sapiens
acgttatcttcagggagtttcaggaggtttttggctcaaggcacccaactgtcaggcacaaagaaagcattgtgtccctaccctcactgctctcctgtgcccaggttattaacacaaattccattattgtcaaggctttggctagaatggcttgttcctgctggggctgaccattagaactgagatggaggaacaaaagctcccccgatcccgatcctaaccttccacccagtcccctcccactccccaggtcccataaagtggcgggagcatcgtagcgtaggaagaagccgccacaccttcctccataacctgggaggatggaagagctcttcgaagctttgctcttcgtgtccccctgaaacaagggttactgtgagtcttgcacacaaggaacatgcgctccaaggttcctagccaggtgggtgctctgcaaagttagggcaaagagagtctggccacatgcagcctctccactggagaaggattttcatctgccaggtggcggggcccttagcctcgttaatcctgcttaatcctgctagaacatacctacagggagcccactttccacgcagagcatcccttgaaggaggggcttcccagaatgctgaggattctgggcttctcagactccgatcagatgcacctcagccctgggatcagtgccccagccctgcctgccagtttcctttttcacttcaccatgagcataagtttgggtgggaactcagcctgttcattcacttcatactgagttcccactctgtgccagggcctgacctgtgcactgccaaaagagcagggaacagcaaaaccctttcctcccaccgtgggccttggagaatgaatgcagggggtggccacgggtagtcgtctggggcttggttctccctgagctaacctcgccagcctggcccagcttgccctgatcccctgatggtccgtgcacatgtgtttatacttgcattgttgactggggtccaattgcctttttggcaaaggcatcaagcattcaaagatgttcagatcttttctgtctggctcttttcctcggaatgaggctccagtgtgtccctttagtcccttagccattatctgagaggctagaattctggcagtgtccccgtgcatctttccccagtggaggagagaactctcggaccagtgagctagagaagcaacccaccccggccgctggaagcaggggaggtgaaatgtgtccaaactcctctcaggctgtcagatggccttgagcggcaccaagtagaaaacgcgctcccacccctgaccttctcctcagcttcattgtgagacctcaagttcctcagcttccaggatgatcaacctagctgaaaacctgaagtccctcccggtacaagtccaagcagtccccagccagggagaccaggtgttgtctgacatcccacacacatcggcacacttgggggattgcaaaagggaggaagggagccaaaggctagggccccggggttcagctaacactcagcacccctcccaaagagcgccccctgtgtgttctggatctctagaggggtttggtttgggccaagtagtgcttagttttaattttctctttctggaaataaatacttttaataagtaaagatgctgctcagctgtcatatcctgcaaggttagaggaaagatgtgggccgtgcgcggtggctcatgcctgtaatcccagcactttgggaggccaaggcaggcagatcacttgaggccaggagttcaagaccagcccaggcaacatggtgaccccatctctacc

SEQ ID NO: 399950 - DNA, 308 bp, Homo sapiens
ttctcttggcttctgtagtccagggtcctgcatgtattgggtgccagcaaatatccgaggagcccatgattgtgtaaatcgagtccagtgtggtgtgcttcgcacagcaacgcccagactgcacctggggggatccaaggagggacccctcatccctccatctgtccctctggcagattctcactgggcgcctgctgggagccgggcgctgggggctccgctgtaaacaagaaaaacaacacagtcctgctcttgaggagtttgtgttctagtgggaaagacagataataaacaaaccagcagataaa

SEQ ID NO: 399951 - DNA, 404 bp, Homo sapiens
tgcctcagcctcctcagtagctgggattacaggtacccaccaccatgtctagttattttttgtatttttagtagagatggcatttcaccatgctggccaggctggtcttgaactcccggcctcaagtgatctgtgctcctcggcctcccaaagtgctgggattataggcatgagccaccgtgcccggccttaaatagcgtttttgaactgtctttaactacataatatgggatggcacaataacgttaatatgagagtgtgcgtagccaacccttctcccacgaaagggaagacctttgtggtcagagatttttctgccctgctcctcacttctagagagaaagaaatatccacatgagaaaaaaaggaattatctttgtaataaagagctgagataggcaatg

SEQ ID NO: 399952 - DNA, 511 bp, Homo sapiens
tcccattcctgaattcagatagagtcggcatagtgagaactcatatgacgagggatgcctgcatatccttatgtgccttggcattagagagtggagcttttcatcagtggtattagaaggtgtggcacaagagcagatttctttgcattcaaagccacatccatacatcacagtatttttagttcccgtgtgtgtgcgcgcacgtgtgtgtgtgtgtattgttaatcatatcatcttgtttacacattttaccattccagatacttcctataagtctcatttccagagacaaagatgctttaaaaagattactgttacgcagttctcatggtaaaacttcttagaatcattggtggatgcccaatctgcaagaaaattttcagtaggagcagaaaatgtgcatggtcttgaagtgacccccacagatcactcatgatctgcaggggaaaacacaataattatagagtggggaactaggacaagacctgaatgaggtgatcagaatgatgag

SEQ ID NO: 399953 - DNA, 1559 bp, Homo sapiens
  misc_feature (1006)..(1006): n is a, c, g, or t
tttactaaatgtttcatttactgaattgtttcatttattccttaaaacaactcagctctattctcggagccgttacttgcagctcagcattgttataaggaataaatgaaacaaaaagtacttaacatagtgcctccacataagatgtcacaagctgctaactactatttttgttatgcattgtctgaagataagtcacaaagttggttcttagctttcaggtaactaatagtgaagggagaaaagcaaccacttaaagaatttacaggccgggcgaggtagctcacacctgtaatcctagttctttgggaggcagaggctggtggattgcttgagctcaggagttcgagaccaacctggtcaacatggcaaaaccccatctatacaaaaaatttgcagggcgtggtggtgcgggcctgtagtcccagctacctggggggctgaggtgggaggattgcttgagcccaggaggtcgaggctgcagtgagccaggatcgagccactgcattccagactgggtagcaaagtgagaccctgtctcaaaaacaaaacaaaacaaaaaaagaatttatagtttccaaggtgaaacaaacaaaccagctgcttaggagaacacagctgattttaacatgttctgaggagcacaatttttcttgctggtactcatgaagaaaacatcttacttcatatttaaaggtatttttaatgtgaatagagtcaaaataatttataaaagtggtctttggggtccagattgatgtgttctaattatgagcctctgtgatcggacttaattcaaagatagatttttgaggggctagaggaatggattgaactttaggaatttctatggatattgtttctcttctctgtgcttttgaaatggcagtgagtgagtctggcattggtaggtgatgctcacacttatgcattccagtgataactttcgtcaagttcaagactgttttggaaaatttctgcataactttgttgagttttagaattntatttgcagttaaaatttttattttaattgtgaaataccaaatctgaagttgtattttaatattctttaagctatagaagtcagtacaacagttaatttttccttagtattaaacatccttataccatagtgtaaaaatgagaaatttggaatatctcacttttatttactatgttaaatgctccattccttctccccaccaggcacacccacataaaaaaagatttttggaaagatgttatagggcagagtgtgttaagagatgagccgggcataatggctcatgcctgtaatcccagcactttgggaggccaaggcaggcagatcacttgaggtcaggagtttgagagtagcctggccaacatggtgaaatcccgtctctactaaaaatacaaaaattagctaggtgtggtggtgggtatctgtaaacagcctggctaacttgcaaggctgaggcaggagaatcgcttgcacccgagatgtggaggttgcagtgagccgagatcgcaccactacagtccggcgtgggtgacagagcaagcctctgtctcaa

SEQ ID NO: 399954 - DNA, 2101 bp, Homo sapiens
  misc_feature (1347)..(1347): n is a, c, g, or t
ttgccttttaaatagcaataaacatggtgtaattggtttaggaaggctgtgctccatggagaagagctggtactacatttaatttatcttgtagcatagtgttttctcaaactatgcttagaagaatactggttcctcgaggtgttgattggtgttgtctggaaatacaaggagcttctgaggccaagtaatgtggcaaacactggggtaggccagttacctggggttaactttccggcaggacttctcagagtctttaatatgctactctgcatcataaattttcaagagcttgccctgtacctatttgtctttcccttttcatagtgctcacagggtttcatggatctcagcatagaaaaggctgctttagggtagaggcagctgccagcagtctttagaaagtgagtgatttctatttcagaaaggtaacactgagcacctgggaaggaaaacgccaaggatgagaaactagacccaaggcaacctataatgaggctgttaaaattttctaggcacaagaaaatgaggctcagaattagggcagtgaaaatgtgagggaagagatagaattgagagatgcttaggaggtagaatggatactccataaccacaaggatggtgaatgagagaataaaatagttgaaggtgaatcccaagtttctagctgggaagcttggacagagaagtgttgggtagaagatgaaaaacaatttaatttgggacatacggataaagatggtcaactcatagccagcaactggtgatactaatgaagcaaggtatttccctgacctcttcatgggtgggaactggagtgcatgggtgctagaactagctggccactttggtgctggcacgggtggactccactctcttggtcctgctgtgtttcaccccttgtgggagcggggggagaacaggtgagtgggtgcaggagccagggagagtgcttttgggcactggcaggagctaaactttgtgcaggcccttcagcagcatctaggggagtgcccactacctctaaagcttcagaaggagtgccacagtgctcctttagctttcctgtctgtggatcacttaagtgttaacagctcagtggagggtcagtgtgacagccttttgcacctgcactcgtggcatctgaattcttgtctggtatcctgtagtaatgaggtcgcatgaatgaattggtgatggtaaatgtgggggattttgttggtgaaagtggctggaaggggagctgaaaaggggaaagagcaggaaggtgaacttcccctggagtctggtcatctccagctggactccttccaaggctacactgtcaagctgtccctctgaagtcangctgcttctctccagtgtccaaccatagtttttcctcatccagcttcttttcctctctctgctggctgagcctggggtttttatggtcacaggatgggggacggggtgggccatgggtggttttgggagaggcaacattcaagagggacaacagggatttttactcccacttttggctgcagtattaggcttttcagcttgaaggtggggccggggacctgccctcttctgcccagagtttccctggctctggtccctatcaataatctgcagttcagggcacagatgaacatatttttatctttctttgatgcttcaagtgactctattatcttgcaatgtcttcaggtcgtcataattaacatcatgttgttgactataaatgtttaacaatgcaggttgtagagagctgtgcttaatagaaagctgaatacaaattattcgttgagatactaacatgtgcctagcacagcaatactacgtaaagaaaaagcaagcaagcaaacaaacaaacaaaaaagggaaaaataaaaagacatatcccttgcttaatttgtttattatcttaagcctagagaaggtattacaagtggtcagaatagcagtgttaagattctgacctttcacttgctatgtgacctagggcaagatacataactttttagtgcttgggttttttcatttgtaaaatattatttgtagattattagtgtctttctcattaaggagttatgaggtttagctagggttaaac

SEQ ID NO: 399955 - DNA, 453 bp, Homo sapiens
atacacttctgcattttgtagtaataaatgggttaaaaactaattactgaagcactccatgggaagaatatggcatgcattaaacaagagacatttttggaatcctgactatccttggaacacaggagcagatggacacctgaaaaactctgccacctggtcagttccacataactttgtaaaaggtcttctaggtcatttctgaagatgattttctcactttgggggcagaattcatccagcaaattagctggctgcagatgcaccctgaggcctgtagttggctggggtcctgctgaggagacgttggcacaggcacctggtttatgccactggcagcaagagttggctttgcatgctgatgatgctgctgccaaacacttaataggtttcaaataatttctccatcaataatcccatctgtaataaacatttcacttatttttctttatc

SEQ ID NO: 399956 - DNA, 401 bp, Homo sapiens
ttgcttcatgttataaatgccagtacaaaaaataaatagaagattaagttgctataatccaatttttaatagccttttttttgtatgatgcaatggtttgaatgtttttctctccagatctcatgttgaaaactaatcctcaatgcagcagtattgaaaggtgaggcctttaagaggtgattgggttatgaggactctgcttaaataaattgaagcatcatttatggattaatgaattagtggattatcacaggaatgggactggtggacctttaagaggaatatatatacacacacatatatatttgttccattgatctaagttggaagggaaggtttagtaagaaatacgtagtataataactaactggtggagccctctgatgactgatgattctggc

SEQ ID NO: 399957 - DNA, 483 bp, Homo sapiens
taaaatacatcaaatatgcttaaatcctcaaattcttaatgatactccccctcatgccctcacaaaaggaaaaattcattagctactttggcggatactaggaaattgattcttttttttttttaactcataaatggaagttgaaacccaacctatttatcctgtcttccctaagtgagctgtagttcagggcaaccaaaccactgaggagccaagtttctctctctaggagtattctagctaaataaatgaggaaggagtgatggaccaagatggtggccatggagccacccctaatgcattagtggaccaggcaataatcatcaatggctgctaatatcacaaaaggagagacaggcagacatttcgtgtcccctgatgggatgcagtaggaggaaccaccacccgtaaggcagatatgccaaagattcaaacttgaatctgattaaacctctaagtccatctgccaacttgcaaaaaaaa

SEQ ID NO: 399958 - DNA, 421 bp, Homo sapiens
caaatataaattgacaatgcaatttgtacatgtaaaggaaagggaaatacagagtattactgatgtccacagaaggggcatctaaccttctacaagaaatgtcaatatggagtgcctttctcttagtaaatttagacagcattctagaacctggtgaaaatggtgacttgaaaatactgactacttggagcaacctagcattattttacaaacattatttctactgcaggacaagcagtgagatccaatcatccatgacctcaagcaaaatcactgtaccataaactaaagttcaaaagaaaatgggtctttgtcttggaaatgtattaactctggggaaggaaaaatcctgtaatagaaattgatggctgaatataatttgggataataaggcaaacaacatgagaataaacactaagta

SEQ ID NO: 399959 - DNA, 382 bp, Homo sapiens
tcgcgctctgtcctgctctgcctggcttttcttcagagtgtgtttccccatctgacattactgtagaaaatggagcagagaacaggaaggggaattagcagagatgaggctccaggcatgtcttcctcttgtccctctccccactgtttctcttgattgtgattcaagtccttacactcatttttacattctcaaatctcaaatcagctaatttcctcttttctatcagataattgcatttcatcagtctaatttttactaatccaaactgtaactttataaggctatatatatgagcatatttataaacttagatttataaactatatacacacatatatgtatcatataaatgcataataaattactttcagactatttc

SEQ ID NO: 399960 - DNA, 444 bp, Homo sapiens
tatataggaagatgtacccagaagaaatagcccatgatatttcagggcaatatcatgtgactagagaaagtcatcttaggctagtaatctccactcatgcccatctagttgagggctcaattcacttattttcaacatccacaaccatttctaaggtgatagcttctctggttacttatcactggtatgaccaaacatcttgatttgcctaagatggctctggtttatgcctattgttcaagaccaacctggccaacatggtgaaaccccatctctactaaaaatacaaaaaattagctaggtgtggtgacgcacacctgtaatcccagctactgaggaggctgaggcatgagaatcgcttgaacctaggaggtggaggctgcagtgagccgagatcgcaccactgcattccagcctgggcgacaagagtgagatttcatctca

SEQ ID NO: 399961 - DNA, 339 bp, Homo sapiens
tatgatttttaaatgtttaatcagttgttacataaactaaaataaattgcattataaacacaaactgttataaattgtgaggtgtttttacatgttatcttctgtgttgtaaaaaaaaagtatatactagttattattatacctatatcacaattgaggaaaccagagaaaattcgttgtgaattgctcatttggaaaatgagaaaataatataaggcagctttagaaaaaaaaatcacttactgttatactgggagtcatgaataataatagaaccagagatattaaatagaccaggcccaggaattacagagtgatctagtttggatgtcccctcca

SEQ ID NO: 399962 - DNA, 289 bp, Homo sapiens
catcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagagattcaaaaga

SEQ ID NO: 399963 - DNA, 396 bp, Homo sapiens
taactcataaaatccttgggatcgccgaagtgttttctttagaataccttttgtctgataggttccagggtggggctggtccctggaaagacaaaggcaggagtagagagttgggactttcagccccacacccaatctccagggaagggataggggctgaaggtcaagttgttcaccaatggccaatggtttaatcaatcatgcctatgtaacaaagcttccataatccaaaaggactgggttcagagagcttccgggtagctgaacatgtggaggttcctgggaaacggtacgcccagggagggcagggtggctccacgcctcttccttccttcatactttgccctatgtgtctgtatcctttgtaacatccttcttaataaagcagtaaacata

SEQ ID NO: 399964 - DNA, 338 bp, Homo sapiens
tacgggccctgggctaaccctccccccatcacacaactcaacagcaacgcccaagccacaacttctctggacctcaggttccctacctgcaaaacagtggcaacaggggtctggagtttcccggtcctctgggatcccgagtgggccagatgtctcggacggcaacacactcacccagcctagagtgccttccacccagggccagtcctaatggcctgggtgaagaacagagactcctggggcctgggtcccacccgagccaccccctagcccaggccacacctccacccgcccaggccgccaataaaacaggccgggcagaacccaacaggcctgga

SEQ ID NO: 399965 - DNA, 257 bp, Homo sapiens
aagcctaacaaggacagcataataagaaaagttacagatctcttacttatttatatgcatgcaaacatcttaaaatgctaacaaagcaaacacatcactatgaaaataattcaggtttaaaaggtaagttttcatttttaatgttagaaaattaatcaatacacttccttaacagatcagagtaataatctcagtgatttcagaaaaaaaaggatcactaaaattcaacacacatttattgaaaaaaaaaacgcttt

SEQ ID NO: 399966 - DNA, 376 bp, Homo sapiens
atcctgcgctgctggtaatacaatggaaacatatcaagtgtggagggttcccttcagagttggaataatgatggagtttgatttgattttagaagaggaacaactaagtccagctgtcagaaggagggggagattggagatccaggtgtctccaattccccttccacgctagccctgtactgagcactactgtataagcactctgggaaggtgtctggacctaggtctggctttgggactggactttgatccctgattatccaaggatctcatttacatttgcctgaaccactcctcaaaccccgtgaatcccagaatttccacatttttttcccagtgaaaggactcaggcattcctgatagatgcgtgcacaaa

SEQ ID NO: 399967 - DNA, 305 bp, Homo sapiens
aataaatttcttcttctttttttttagagacagggtcttgcccagggtggagtgtagggatacaatcatggctcgctgcagcctcaaatccctgggaggatcacttgagtgatccccctgcctctgcctcctgagtagctgggactacaggtgtgtgccactgcacctagttaatttgtatttttaatggagacagggtcttgctcattacctagggtatagtgcagtcgcataatcacagctcactgtagccttaacttcccaggctcaggatcctcccacctcagtctcctgaggagctggga

SEQ ID NO: 399968 - DNA, 634 bp, Homo sapiens
ctgcagtgagccatgtttgtgccactacactctggcctaggcaacaaagggagaccctgtctcaataaataaaatataggataatgatatctgtaaattctccagtaaccagagattaatactaaatgtatactcagggtagaggagagtaagcaagagaatcacctgtaattttcaaagcagtaatattactgagagctggctgaaaaatatactaaccttcagtcatttttgagtcattgattcatattctgatttattataacctaacagtgctgtttcaaattagtacccagtgctcttagtcgcttgggtactgtggttcattttgtggatttgctttagctactttgtttagaccatctgccaaaagttaattgagactgtacaaggcttccaagagagagcagatgtacccatggctgagagtggtacagcagtggacaggcatgtgtccgctattggcctttgacctttttaagcaaggagaaacctttcttctgttgtgcttttttgtgacttttggtttgttaaccactattctaaaatcctttatatcatactgatgaatgcaaagtgaggtgctttttttcagtgagtcagtgtgcatgttcaggattgattcattggaata

SEQ ID NO: 399969 - DNA, 579 bp, Homo sapiens
ctgcagtgagccatgtttgtgccactacactctggcctaggcaacaaagggagaccctgtctcaataaataaaatataggataatgatatctgtaaattctccagtaaccagagattaatactaaatgtatactcagggtagaggagagtaagcaagagaatcacctgtaattttcaaagcagtaatattactgagagctggctgaaaaatatactaaccttcagtcatttttgagtcattgattcatattctgatttattataacctaacagtgctgtttcaaattagtacccagtgctcttagtcgcttgggtactgtggttcattttgtggatttgctttagctactttgtttagaccatctgccaaaaagtggtacagcagtggacaggcatgtgtccgctattggcctttgacctttttaagcaaggagaaacctttcttctgttgtgcttttttgtgacttttggtttgttaaccactattctaaaatcctttatatcatactgatgaatgcaaagtgaggtgctttttttcagtgagtcagtgtgcatgttcaggattgattcattggaata

SEQ ID NO: 399970 - DNA, 461 bp, Homo sapiens
attagaacagaatttctcaaattgtgctttgtgagatgtacaagtaagaaattccttctgagcatgattgaaatattttaaaatacctaataaggaggtgtaatattgagtaaggcctttaagtgggtggcagggggcaggatcacccttgtaagcaagcatttgtgtaacacgatattactttgagatactacattttgaattttattttcaatgtggtgctttattgtgataaggcactgtatcggctgttgggtttttctttttcctcatcatcaactatctctattcaatatccattttcctatcagctagttaatataaatgtactgctaatttgatgcttaaaactgtgtttggactggaaaaattgataactcattgaagcatatggtagattagataaaagttcaaaacagtctaagcaaaggcataacacagggatcattagttcaaaagcg

SEQ ID NO: 399971 - DNA, 792 bp, Homo sapiens
ccagatgacaagaatgtagaaagggttgtttgaaacatgttagaggagaacattggaaacatcaaacactgtgattgtaagcaatggaaataactgtcctaaactgtaaaacaatgcaagaacatgaagatgtcaaagcccatggtatgttcatttagtcattctccggactaaaaatatttgtattttctatcaacaagagtttaccttgatatataaatatattcatgcaaatgtgcatattaataagcacacatgtatgtatataatatacatatattgtgtatatatatgtatatgtgggtgtgtatttccatgtattgaggtttttcagagaacgaatgtcactagtaaacggtagaaaatgtatgttattaaacctttatttactaattttcttaacaacaacactaaagctagaaaataaaaaggatcattcatttttaaacagatggcacctgtagaccgtctgccatgctttgacaagctcggcatgcctcccttacatgttgaacatcaatatctatagacaactctatatatgttctcatgagggtaaaggctatgtcaaataactaccaatatgtatatgtaattattttctatgtggcatatactagctgtcatattttcacttaataataaatgctttcagaaatagggaccattttgtattttttctatgttctccatgacacatgtcttgagactattgtcccttcctatacaattgaaattatatatgtttctgccacagtcattttcatacaactggcctttggatttcaggag

SEQ ID NO: 399972 - DNA, 846 bp, Homo sapiens
ccagatgacaagaatgtagaaagggttgtttgaaacatgttagaggagaacattggaaacatcaaacactgtgattgtaagcaatggaaataactgtcctaaactgtaaaacaatgcaagaacatgaagatgtcaaagcccatggtatgttcatttagtcattctccggactaaaaatatttgtattttctatcaacaagagtttaccttgatatataaatatattcatgcaaatgtgcatattaataagcacacatgtatgtatataatatacatatattgtgtatatatatgtatatgtgggtgtgtatttccatgtattgaggtttttcagagaacgaatgtcactagtaaacggtagaaaatgtatgttattaaacctttatttactaattttcttaacaacaacactaaagctagaaaataaaaaggatcattcatttttaaacagatggcaaaaacactccctggggaagtccaaccagactgatgttttgtctgcatcaatttccctgtagaccgtctgccatgctttgacaagctcggcatgcctcccttacatgttgaacatcaatatctatagacaactctatatatgttctcatgagggtaaaggctatgtcaaataactaccaatatgtatatgtaattattttctatgtggcatatactagctgtcatattttcacttaataataaatgctttcagaaatagggaccattttgtattttttctatgttctccatgacacatgtcttgagactattgtcccttcctatacaattgaaattatatatgtttctgccacagtcattttcatacaactggcctttggatttcaggag

SEQ ID NO: 399973 - DNA, 153 bp, Homo sapiens
attctatacctagtaaaatgatactttaaaagtgaagaagtaaaaactttctcagactaacaaaatctgagagattttaatgaaggcagacatgtcatgcaaacaatattgaaaaagggagagtgaaataatataggtcagaaactcagatct

SEQ ID NO: 399974 - DNA, 487 bp, Homo sapiens
ttcagaaaagaagaaataatatcaagtatcctttctggctacaatggaataaaacaagaaatcaataacaagaagaacctcagaaactacacaaatacatggaaactaagcaacatgctcctgaatgatgaatgggacaatgaataaattaagaaaaaaaatgtaaaaagtctctcaaaacaaattaaaaggaaatataccataatctgggggatacatcaaaggcaatactaagaaggaagtttatacaacaaacaactatatcaaaaaagcagaaagatttcaaataaataacctaatgatgcacctcaggaaactagaaaagcaataacaaaccaaaccctaaattagtagaaggaaataaatactaaagattagagcagaaataaatgaaattgagatttaaaaaatacagaagatcaatgaaacaaaaagttggttcttttgaaaaaataaaatcaacaaacatttagctagactatctaag

SEQ ID NO: 399975 - DNA, 410 bp, Homo sapiens
tccacgtcacaaacatatccatcactttcttttctctttctcttttcttttctttctttcctttcttttttctttcttcctttcttttctttcctttctttccttctttcccttcctttctttctttttcttctttctttctctttttcttttttccctttttctttctttcctttccttttctttttctctctcttctctctcccttccctcctgtcttccctttccttctttcctctttccttctttctccttcctcccttccttcttttcttttctttctctttctttccttctttacttttcttttctttccttctttctttccaatatacccagcatccctctcacccatctcctggaaaccatcattctattgtctatttctatacatttgactaccttagatg

SEQ ID NO: 399976 - DNA, 357 bp, Homo sapiens
atctcaagaaccattaacctcatcaggttcttaagttttctggtacctagctaagttctttgatttatatcctgatctagagttcctggacaagctaggctgatggttgaatgagtcattcatacttgttaatcatatttaatttaattttctaagtgcagtatttctggatctgttccattctcatattctatcctcaacaagcacagctggtattaaaaaaaaaaattaccacgcaatcaggaaacatagcacaagcacacatggtcagatggtgataaatgtagagaagaataaaggtggcaggaaataagaaatttttactctctgaggtcttccacaatgcaggatgaatgt

SEQ ID NO: 399977 - DNA, 573 bp, Homo sapiens
ctgttttgtacccttaacacttaagagtcttaacacttatttctaatgtagagttgaggaaggaattataataaacctatgagaaatctctgttgagtaaaatgataaataatatccttgttaatttattaatttatcttatcttacttttgacagctatttatagtactttcaatttcaaaatagacaaaaggtttgtcttccaatttgtatgtggtaattagaaccattgtaacttatgacctccccaattgaataactgaattattttatagaaataacatagtaaattttgtgaatagagaaaaagaagccaagaagtcatagaagagagaacaaggggagtggactttgagtattgtaaaaaacagtgggtttggcagagttcactggtgtcttaaaaacatttaaaaatgaattagtgtgatctagtaatagagttttgcatttttttacttaatattataatgtgtacattttttcttgatgtaaaattttttctaaagcatgagttttaaaattgattgtgtatagcattccatagtttggatttactataatgatttaccccat

SEQ ID NO: 399978 - DNA, 450 bp, Homo sapiens
taaccaggtgctaggccatggacatcactttctcagcccattgaccgtcctgtgtcttcaggacaagaaccagcactgagccttccctttccttcaggtgcctaaagtcaacatcaatagtgttcaaaaatccagaacgtaagatctactactaaagagaattattacagtcaaggaaaatgcttgaataaagaaggaagctgaattctgtaagccgccaggggctacaacaaacttttaagggatacaagttcttaatattctctgcagcccactaatacatacagaatgggtagaaaacacgccaggcgtggtggcaggcatctgtaatcctagctactagggaggctgaggcacgagaatcgtttgaacccgggaggcagaggttgcagtgagcagagatggcgccactgcactccagcctgggcgacagagtgagactttgtctca

SEQ ID NO: 399979 - DNA, 626 bp, Homo sapiens
agcatatcaaaaagatacttcaccatgatcaagtgggtttcatactagggatgcagggttgatttaagagacataagtcaataaatatgatacatcacataaacagaattaaaaacaaaaatcacatgatcatcttaatagatgcagaagaagcatttgacaaaatccagcatcgctttatgattaaaaccctgagcaaaattggcatagaagggacataccttgaggtaataatagccatctacaacaaacagataacattatactgaatagggaaagttgaaagcattccccctgagaactggaacaagacaaggattcccattttcaccacttctattcaacatagaattggaagtcctagccagagtcatcagacaagaaaaagatatcaagtgcatcccaatcagtaaagaggaagtcaaactgtcactgtttgctgatgatatgattgtatatgtagaaaaccctaaagactcatccaaaaagctcctaaaactagcaaatgaattcagcaaaggttcaggatacaaaattaatgtacacaaatcactagctcttctatataccaacagcaaccaagctgagaatcaaattaagaactcaacccctttcacaatagctga

SEQ ID NO: 399980 - DNA, 290 bp, Homo sapiens
gaaaaattacagcaagctgggtgcggtggcttatgtctgtaatcccagcactttgggaggctgaggcgggaggatcacttgagctctggagttcaaaaccaacctaggcaacatagcgagaccctctctctacaaaaaaaaaataataataataattagctgggcatagtgacacacacctgtagctcctgcttcttgcgaagctgaggccagaaggtaaaggctacagttacctatgattgtgcctctgcactccagcctgggcaacagagcagactcagtgtctccca

SEQ ID NO: 399981 - DNA, 102 bp, Homo sapiens
atatctgatatagatttcagtctttctctagtgttcatgaaaataaagccatttaaacaaatggctattcaaattaaaagatgtgatggaaacttcatcttg

SEQ ID NO: 399982 - DNA, 2149 bp, Homo sapiens
  misc_feature (619)..(619): n is a, c, g, or t
  misc_feature (680)..(680): n is a, c, g, or t
  misc_feature (1468)..(1468): n is a, c, g, or t
aaattcaatgcaatgtctcacaatagctgcgctctccttcttccaagcacagagattctctctctacgccacaaagccactgccatgggatggggacgggtggcatcagcaactcaagactgtcttccctaccctcttcattgcctctttcaacagtatgaagttaaaatcagctctgaagatgacaatgcattcaaattcaccagatcacccccagctctgaagatgacaatgcattcaaattcaccagatcacccccagctctgaagatgacaatgcattcaaattcaccagatcacccccagctctgaagatgacaatgcattcaaattcaccagatcacccccagctctgaagatgacaatgcattcaaattcaccagatcacccccagctctgaagatgacaatgcattcaaattcaccagatcatctaatgaagtttcacttctgtttcttagcacctccctgactcttctgttccctagagtggaaggagggtctgggaaaggacctttgcctgaaactaagaagtcaacatgatacccctcaatatcccacctgggaagggagctgccaatgagccgaagcagatggggaggagatgaaactgggctatcngctttgcaggctggagccccctcctgtatctgccttatcttctggtatccccagcacttgncccttggccttgtagaaagcaggaatgtgatacatgtttggtgaatgaatgagtgaattaattaattaatttaatatattaatttgtatctatttcaaatagagtctgaagctcaattaatactttaaaaatacagctgggcatggtggctcacacctgtaatcccagcactttgggaggccaaggcgggagcatcgtccaagagtttaaggctagcttgggcaacatggtgaaaccccatctctaccaaaaatttaaaaaaaaaagaattagctaggcatggtggtatgcgcctgtagtcccagctactcaggagactgaggtgggggaatcacttgatcctgggagggtgagactgcagtgagctgagatcacggcactgccctccagcctgggtgacaaggtgtggccctgtctcaaaaataaataaaaataaaaatactatataatcattcattctaaaacagaagttataatcatgcctatccctagggccattgggaagattaaatccatgaataaatgtaaaacacttagaccagcgcctggcacataccaatcccgcaataagctattcatgtaaactgagagtaggttgtcccactccatgtgggattaggggtcagtgtaggaccagggtcagagatcaaggggagaatcacgcaaaaatttagtatgaagttaggattagaggaccagtttgtgtccacccagcagtcagattttttagttaccatctatttgtttatttatgtcccacattgttccaggaggagtcaaggcagctntcaggaattctaactacagaaatcaagaaagagaaagatcaaagttactatggactgaatgtttgtgtcctccccaaaattaatatgttgaagcctaatccctaatgggatggtattaagaggtgagacctttgagaggtgattacgtcatgaaggtggggctctcatgaatgggattagttcccttttaagaagaaacataaaaggaaaaaaagaaagaaagaaaaaaagaaaaaataataaaaagagaagaaacgtaagagagaaatggtatttggacaggtaagaaaaaaagccaggagaattaatggtcattggatccaaatgcaaaggacctcaaagaatgtgctcatccacctcattgagtgttgcaggaaggtggagaagaataggctactctacttggaaactaggaagtccctgattagaatagaagccagaccaacagtgttaaaggaatgaaaaataaagcagaaaaggcagcacatgtagactgtcctttctgaatctttcaaacacaggtgagggcaacagtgacctaaggacaacttgggaagcaggttaggggttctaagactgggctccatacacacactgcttaagttcaaatcatagccccaacactcaatagctgtgtgactttgggcaagttaacttacttaactttcctaagtctcagtt

SEQ ID NO: 399983 - DNA, 421 bp, Homo sapiens
cctgtaatcccagcactttgggaggctgtggcaggtggatcacctgaggtcaagagtttgaaaccagcctggccaacatggtgaaaccctgtctttactaaaaatacaaaaattagccaagcatggtgacacgtgcctgtagccccagctacttgggagattgaggtaggacaatcatttgaacccgggaggcggagcttgcagtgagctgagatcgcaccactgcactccagcctgagcaacagagggagactccatctcaaaaaaaaaaaaaatctgtgacaaaaaagtacatgttttacaagaactcatacaaatagaaaaatacacatcatatgctttaggatggttgcttatgaggaagaagtaagagggctgggaagagtcaaaaggaagaaataagtggcatttgccttatttt

SEQ ID NO: 399984 - DNA, 1445 bp, Homo sapiens
agaaaggtgattgtacttgccaaatctaaatggaccaggatgaacaaattaagtctccctcctgagtatctgaacttgccatactgaatcagttatatgggcatggcactggagctgtactggctgtgtggattcagaagctactggccattgggtacaaatgcagagaatgaaggtaacagaaaggaaaacagaagacaaatgcagagtagaaatgagagaggatgcaatgtgaggcaaaccaagacatacagagacagagaggcagacaggcacatacacggaatagcatgtttgttgttttaacctgctatgttttgttatgcagtaagataattaatacagtgggtgcccagggctggcaaaatgggaaaagggagaggtaatggctaaaggggatgagctttcttttggaagtgataaaaatattctaaaattgattatggtggtggttgtacaaatctgaaaaccttgaattgtacacttcaaatgacaattatatggcatatgaatcatatctcagagctgttacaaaaaaacattctataaagtcacttctgaaatcttacatgaaattttgattatgtcaaaaattaagaatcaaaaagttcttgacaaaaataactaatcaagagaatgaaggtgacttcaggtaaaagcagattaaaaagactagacaagaaaaggtatctacagatataagaactgttaaagaagtagtaaggctgggcactgtggctcacgcctgtaatctcagcactttaagaggccgaggcgggcagatcacctgaggtcacgagttcaagaccagcctggccaaggcggcaaaaccccatctctactaaaaatacaaaaattagccaggtgtggtggctcatgcctgtaatagcagctactcgggaggctgaggcaggagaatcgcttgagcctgggagatggaggttgcagtgagctgagatggtgccactgcatttctgcctggcaacagagcgagactccgtctcaaaaaaaaaaaaaaaagtagtaaaactgcatttgctggtgatattgttggatatttagaaaaactcataagagtaaatggaaaaattactatagataggagtttagtaaagtagccagattatataagattaaacaccagttgtcatatacaaacaaaatacacatgttaaaatactaaaaagttaaaatataattgaaaagacctttacaacagcaacaaaaagaacaaaaaataccatggcaaaacctatatgaaaagtttaaagtttcttgaaagacttaaaaatagacttgaataatagaaagatatttcattcttatatacaaagtctcagcattattattagttcttcctaagttaataaatgtaatatcccaataaaaatagcaacagattttcccctggagctatacaagttacaaataaaagttcctaaagg

SEQ ID NO: 399985 - DNA, 598 bp, Homo sapiens
cacataataatctcttgctattttagggaacagtatcagctttcaactggacacccttttttgtggaagaatttgaaaagctgtttccatatgagaaacatgattttgttttgttctgttttttttgagacagtctaactctgttggctaggctggagtgcagtggcacaatctcagctcactgcaacctccgcctcctgggttcaagtgattctcccgcctcagcctgccaagtagctgggactacaggcatgtgccaccacgcccagctaatttttgtatttttagtagagatgaggttttgccacgttggccaggccggtcttgaactcctgacctcaggtaatccacccagctcggcctcccaaagtgctgggattacagacgtgagccaccatgtctggcccatgattttattttctaaccatgtggtcatgaatgtgtataacaaggtcagggcccagcagcccttggcacgtcctgacttgcacagccacttctcctgaatgccctgtcgcccatccaggcaccgttcattcacagtgaaacgtggttctctgtcagcggcacactcagcttctccagggcctggtcagaa

SEQ ID NO: 399986 - DNA, 668 bp, Homo sapiens
ccacacctcccacaggactgggctgagcacagtcatgcattaaaaaagcttctgaacttattttggaaagagtagctccctggagtgtggaggaggacaggaatttgctatctgcaggacttaaatcaggatagagtatcaaatattccaaggccttacatgcatgttttgttttttgataaagacagaagattgcaaatggtttgctctttaacagtcaataaaatcatatctactaatcaatacatttgaagtttactagattctcaaactttccataagatttgagttcattagtttaatgggatcgatctgagaaaaattagatttatgtgcagattttagctacccttgtccttggaatgtgtatgcacacacacacacatctgtgagaatgattattttctacttgatacagtgtgcatcaaataaaagtttactatattggaatatgggaataaattcatttataattagttgaaattgtccagacacatattttagaaaagtatgttatttttgttttaagtttggaagaacctgaatgattaaacctgatttaagtccctctaacaattatgaagaaaaaaaaagactagattttatatcaacttaattgtcttttggtttaaaattatgtatccaataaagacatttaaaaagtaaat

SEQ ID NO: 399987 - DNA, 456 bp, Homo sapiens
ttttagaatgttctagtcaacaggtaatatgaattaaactaatcgagggtgacagggcattatatcagccacttatcaacaaacatttcagagaaaaatagttccttgtattgttattgcaattttctttgagattgccccctccaaaacagtaagaactttcaaaaacaaacaaatatatcaagccacagattcaaagtgctataaactccatgcatgattagttctcactcataggtgggaattgaacaatgagaacacatggacacaggaaggggaacatcacacaccagggcctgttgtgggggagggggaggggggagggataacattaggagatatacctaatgttaaataacgagttaatgggtgcagcacaccaacatggcacatgtatacatatgtaactaaactgcacattgtgcacatgtaccctaaaacttaaagtataataaa

SEQ ID NO: 399988 - DNA, 452 bp, Homo sapiens
tcccaccagtgacccctccatgcaggctgcctggctggcttgctgtggggggcaggggggatggtgcagtgcccaaaggcgcagctggggcagggacgggtccgcagggaagcaggggtagcctctcagaggttttgtgtgctctctgttcctcaaccattggtttaaaattttaagcctgtagaaaagctgcaagagcagtggagggggcatctgaggccccaaaatcaccagagtccttgacattcatatctgtgctctctccagctctcccagatagcctgatgcctgaacacctgagagtgctggctgagcccagggcacactcttgcacacacccaaagcaggaccacgctcgagagactccacgtggggccgatgtggtccatgcccagattcttccagttgtcctcatcatgttctttctttttaattttttaataatttttctt

SEQ ID NO: 399989 - DNA, 353 bp, Homo sapiens
cacatgttaagtatagcaagagctgaacgacagaagcccgggtcccaggtgaacccatggagttgctgttccaggttggccctggctagcatttgacctctcatagatgtcataaataaagttctcttttatttaaggcactattacttttgagttttctttctgttatatgcagatgaagttaatattaactgattttaaaaatttctagtaaaactgctgctcccctccccccagaaaaaaataggccacacttctcctgaagcctcctgtagccctgggtttgagtagcttggaactacggacaatgcaagggtttaaggtcagtggatttggggtccaaatccacctat

SEQ ID NO: 399990 - DNA, 444 bp, Homo sapiens
actttcatggggaacattaacaaactcacagaattccaacctccaataaggttactctgagaccatgataaaatgaggcaaggcaaggccatgtcataattttgtctaagcactgacaaaaacaaggtcactatgctgtcacccataaaataccaaataatctctctcggctaaagtgagtgactgctatcctttgaacagatttataaagatctaattcacataccatttaactcatccattcaaagtgtataatttggtggctcatgcctgtaatctcagcactttgggaggccaaggtggagaatcgcttgagcccaggagttcgagaccaacctgggcaacatagcgagaccctgtctctacaaaataataaattttaaaaattagctgagcattgggagttcaagaccagcctggacaacacggtgaaaccctgtctct

SEQ ID NO: 399991 - DNA, 454 bp, Homo sapiens
gtttttagccagaatgtagcctcaccagaagttgggtgctatgttgttgaacctcacaacctacataattgtgagctaaataaatctcttttctttataaactatccagccataggtattctggtatagcaacaccaaatggactaagacaagggggaagaaaacacatgattatctcaattgatatagaaaaagcatttgacaaaattcaacagcctttcataattaaaaaacaagtcaacaaactagaaatagaaggaaactgcctcagtataataaaagccatatgtgaaaaaactcactattaacataaaactaaatggtgaaagactgaaagctttttctctaaaatcaggcacaaagcaatgatgcctacttttgctacttctattcaacatagaactggaagttgtaaacacagtatttaggcaagaaaaagacataaaagacatcc

SEQ ID NO: 399992 - DNA, 414 bp, Homo sapiens
acattactcctgcatttttacctacgtttggatggaatgaaatctgtgaatgcaatcccataaatacatgtttgaaccaaagcaagacactatcaccacaagaggcatgagggaagcatgccaaggggaaaaaaaagcagagaaaagggcatccgctattacgaagttgtgataagcattgtgaagtttcaaaaaagaaaataatttaggagctctaattaaaacaaaaaaaagaaaaagaaaaaaaaagctggattcagtggctcacgcccataatctcagcactttgggaggcagaggtgggcggatcacttaagatcaggagttagaggaagccgggccgaatggtgaaacctcgtctctactaaaaatataaaaattagccaggcatggtggcaggtgcctgtaatccca

SEQ ID NO: 399993 - DNA, 389 bp, Homo sapiens
ctgccgacaggttgggggcacaaacggcgaactatcccggcctgggtcccggcctcgaggccatcagaactcgcagtgattggaggtggacgcagcggctggaccgggagcgcgaaactgctgcgctctccccaggatctgcgccctgcagctacagaggggacatgttctcaaggtggtgaggcagcgggggcccaagcaggactggacgttgagcgccgcgtctcctccatcggcgcagcagtgggaccgatcctcgcggggcaaagagcccgcgaggggtgggggaaagcccgcgagagtcccggcggcgtcccgccgtttgccggctggagcctggccccagttccccgcagccactcaagcccggtggagcccactcgcggccg

SEQ ID NO: 399994 - DNA, 483 bp, Homo sapiens
ttactctatttttctcaagttttcttttggtcccttccctgaacccactattccttcaaattcaacaatgccccctaggtttcaagctgcttggcaacagaccttccaatgcattatgcactacatgttcaaagtgtcatttttaaacaaaaaaactaaagaccaactctgcattagaaagtcgtcactaatccctgtctttcatgaaaaagtcttctgaggagataaaagagtggaaactagaaagttcccacaaggttctgaaattttctgacttctcagcatcaatctattatgattcagactctctcctaataatttacaaacttcaggttataaagcaaacacaggcaatatcaatagagttagtataatcagtttaaaccatagggctctgtactttttaaagggactatgtgtgtgatggtggggaggtggggcatgtccgctaagtttggtacaacaaatcccaagcaaagactt

SEQ ID NO: 399995 - DNA, 183 bp, Homo sapiens
acatcctaaatctctcccagtctagtgtgctaaatttgctgacttcctcccttagtctttctgaattctggcatttttaagtgtatatattcttttcctcatatttacttaacagtgtgggctggaaaccactccgtgtccattcataatgatcttcctcagtctgtttttataccattggat

SEQ ID NO: 399996 - DNA, 346 bp, Homo sapiens
tgaatgactccagcttcctctggaagtaaagcggctttgagaagcgtttttattaaagacgcattaatgatagaggacccttgtgtagtgaggaaacctcttgcatggtggtgcaggatatggaaggcatatatagagtcagtataaatactgacatgtagtccctttgcaagagtgagggtttgacttaaggcaatgagttcggcttgctgagaggtagtggagcggggcagagcggtagcctcaatgatagatgtggaagatactatagcatagcctgcctttgctggtgagtggcgattaggcctggtggaactgctatcagtaaaccaagtgtgttcagggt

SEQ ID NO: 399997 - DNA, 440 bp, Homo sapiens
aagagttattgttgtgaaagtgtcagtcagtactgaagtaactatgggggctgaacgcagtggcacatacctgtagtcccaacttcttgggaggttgaggtgggagggtcacctgagccccagaggtcaaggctgcagtgagcagtgatcatgccactgcaccccagcctgaacgagaaggcgagactgtctcaagaaataaaaacaaaaacagaaacttattttattagatacccaatctatgtgacactaattacaagtgaatcaagatttaaaagaaaatcgtgctaaccacattaactctcagtatagttttatgactattacaagccatccaaatctattcctacttattcggtttactaactagtatattcagcaagtatttatggagtgcctgccatgacaaaggccctatgctaagcctaacacatatacaa

SEQ ID NO: 399998 - DNA, 476 bp, Homo sapiens
agatgtagagaaggttattcatcaattgacctgaacatgggggtgtctccaggtggacctaatctaatcaagcaagcctcttaaaagcagactttcttctagctggtagcagaagacattcaagatattggaagtttcacggagatttggcatgaggttggctttttgtggaggtggagggggatgggtaaaaagacctcaaagcagattttaggaactaaacgtgaccccgtgactgaaagccagcaagaaaactggcacctcacgcttgcaaccacatggaactaaattctgccaacaacatgaatgaccttggaaagaaattcttccccagatattccaaataagaatgtaatctgggcaagactttggttttagcctcatgagatcctagaccgaaaacccagttgagccctcctggacttctgacctacatatctgtgcgacaataaatgggtgttgctttaagcagctaa

SEQ ID NO: 399999 - DNA, 305 bp, Homo sapiens
gggaaaacaaaattattttattttttattgaaggcttcacgaatttgcgtgtcattcttgctcgggggcaatgccaatctctgtctagttccaattttagtatatgtgctgccaaagtgagcaccaaaaccaattttattaaggaagtaaaaactcgttttttgctttttgttttttttttgctttctctgttgcaactttcccacagattgtgctgcgcatttgggcctgaacagaaaaatctgaggcttacgcagcatgcgtacaatcagcatctctgtggaggcattcccagcagcactctc

SEQ ID NO: 400000 - DNA, 449 bp, Homo sapiens
ctgtcactctgaaatgctgtaagtctctaacgggactcaaattgaacaaataataaaaggtatgccatgtgaaaggcacatttatctacatgagtctattgactattgctctggacctcacagagatcagataggatggaaaccatttattttgtaaagaaaggtaaatcattaatttatttaatgcaatgcatttctcctgtggggcggttcgagcagttcttgtagcaacaggggcaagtgttgaagtgcaggctgccatttgatgtccatagcccatcgttcagaactgatgcatccattcccctagttgctaggagcattggaggcttacagctccatgaggattgcctgggtctgaagggatcttcctccaccaagatccctggtggcagcttctatcaatgcaggagtaaaaagatctagcccccttccctcagctcagatga

SEQ ID NO: 400001 - DNA, 411 bp, Homo sapiens
acatggagaaattcagaaagttgccgtgagacctcatgccttgtgatctgtctcataggaatctctaagcatcacctcttcagcagaacacttgtgtcctcataaattatttatttcagagcctacttacttctgagataaaggtgatcggcccaaagtcatagaatttagacaatgaatgatcttaaaaagtagcaagtatgctatctcattttgcagatgagaaagctgtgatttcagagaggagcagtagcttatcaaaggccgtgcaagtcaatttgtgacaaagtgtaaaccagacaaaaggttatcacaaggctcatatcatggccagctgaatgactgaaaacctggatatatactctataaacaatgtcatggtgctgtggcgcaaagaaagttgaattgcag

SEQ ID NO: 400002 - DNA, 476 bp, Homo sapiens
attttggatattagacccctgccagatgggtagactgcaaaatttttctcacattctctaggttgcctcttccctcagatgttagtttcttttgctgtacagaagctctttagtttaattagatcccatttgtcaattttagatcacaaagcattttctatgtgtatgtgactatagtgtattatagatactgacgagtgttagagataagactggaaaaaattcaggtaccaaataatgaagggaatttggatcttatgctggagttttcacagaactattgaaggttgattggccaaataataaaattttctgtgtttcgaaactttctgtatagtaacaatgtaaagtcataatagggatagtttggagattaatgcttcatgtatcatactccatgtaacaattaatcaggcagatcacaagatcaggagtttgagactggcctggctaacatggcgaaatcccgtctctac

SEQ ID NO: 400003 - DNA, 497 bp, Homo sapiens
tccctgggcccagggggccctgtgaccccacacagacttcctggctacatgcaacacatgtgcctatgtgccctgtgtgcccaaataacacaaccatctccttaagcatcaattttggccaaaaaatgcctctctctgataagagcctttcctctttcacagccacagctgagagggtgggtccctttgtgccagcagtgtgggtttctccacagcagggaaccactgttacccagtgcaaggagggccttttcagagaggcattgataggtgttgattggtttctgtttatctgacaaggtcctaccatacacactgataggcacttgattttatggcttcctaatatctcttgcagaactttctgtgtcaacactcatatagttgcatcacccgttctttggctatctggtatcacctgctatgcaccacaatttatttaactagtacctattgatggacacatttgctgtttatgaataaacgctgctaacaac

SEQ ID NO: 400004 - DNA, 1847 bp, Homo sapiens
  misc_feature (304)..(304): n is a, c, g, or t
  misc_feature (821)..(821): n is a, c, g, or t
  misc_feature (1639)..(1639): n is a, c, g, or t
caaagggaatttagctgtgtacttcttagggggaggatagagggactgggttgaaagagggggttgcccaaatgtagcaatgactcctaaaatttaagaaaagggatgtggtgatgggttccataaggggctgggacctttgtggaagtcccagtaaggcagtaggacttatgacagagggtgctgctgtgctttcagaggtggggagtggctaaacatccagcatcatagtcttgggactggcagcaaaagatgccatggcccacattggcagaggctgtgtcatcagctgcctttgaatggnccatcttctcatatatatagtgtgtatcctactggcaaacttggaggttcaaagactggaggctgtttcctaaggtttttttgtgtgtgttgttgttgtttttgtttgttcgtttgtttttccctatgagaatgtacatcacactaacaagggaaaagagtcctcagcagtaaatgatattaggtatcttcccttaaaaatggggggatgagacacagatttaatttaatttataaaaattaaacatcatcagccgggcgcggtggctcatacctgtaatcccagcactatgggaggctgaggtgagcagatcacctgaggtgttcaagagtttgagaccagcctgaccaacgtggcaaaaccccatctctactaaaaatacaaaaataaccaggagtggtggcacatgcctataatcctagctacttgggaggctgaggcaggagaatcgtttgaacctcggaggcgggggttgtggtgagctgagattgcgccattgcactccagcctgggcaanaaaagtgaaactctgtctcaaaaaaaaaaaaaaaattaaatatcgtgttatttgcatctcagatttgtgaatcaaatttatttttacacagattactccatgtaatatctgcaaatgttttaactatttattgtaggtaagtagttatcatcttttttagaagggaaactgaggcacagtgaaatacacaccccccacacacactgagtacactaactcagaggtaggtatgatagacagaagacctgtttgtatttcaaggaattatttgagtgcgagtaacaaaaaaaaaatctaactggtttaaaccaaaaggaaataattgactgatgtaaactgaaagttctggaaatagggctggtttctggtagtgggactcaaattatattatcagaattcagttcctctctacttctagactctctgtcttctgttctgactttattctcagattttgtgcaggggcaggatggctgccagcaagttcagggctatcatttcccaggtttgactgcagctgaaaatgtggctcccctctcatgaccctcccactggtctcattgtgccttgttggctccggttgggtcccagaaccaatcactctggctagggcaatagaatgctccttttggccatggctgaatcacccagacactgttggggtttgggtgtgggagaggacactgttggggttcgggtgtgggagaggacacctgcacctgcacagggactgaggctgaaaaggaaaatagaagcactcttccagaagggtgaagaaatgccgatagtccaaatcaaagtgataacaaagaagatgntcagttcagccttctctcatagcctacttcttgccttctagcctagagccacctgattgtcccttgaagctctgaaatttaaattgaaggataaatataaattgtgtgaaggaaggccctttacagtaaactgaataatgccccccaccccgaccccaaatatccaggccctaatccctggagcctgtgattatttccttatatggtt

SEQ ID NO: 400005 - DNA, 410 bp, Homo sapiens
tgtggaagaaggccagaaacagctgcttcctaattatgaggagcatgaacagggcttcccctgcacaggcgctctctctttgcctgctgccatccatgtaagaggtgacttgctcctccttgccttccaccatgattgtgacgcctccccagccatgtggaactgtaagtccattaagcctcttcttcccagtctcagataactacagttatttcttcctggttaaaagcaagcctccagaatcagacacaacagtgtccaaatatttactctgcaacacaaaactcaagactgaaatcaagatcagttacatttatgatgtgatttgaatgatccttggaaggtacaagctgcaaaaattacatcagaatatttgtttacaaataaaaatatatattgggaatgtgtga

SEQ ID NO: 400006 - DNA, 345 bp, Homo sapiens
caagaccctgtagaggcctccctccacgctgcctccctcccttccccgctcccctccacagaggccttcccagctccccactaacttccgggcagcagcagagtcctacggggcgggggggtgccggtagccttcatctcactccccttctgcccccgcaggccacccagaaggtgggggtggaggacagttcagccgcagcctggaggctcactgagcagggcaccgtcccacacactctgggtgcctcgggggctggatgtcatgtggcgagtgccagcaggaaaagcgagaggacactgtggccactagagcaaagttggagcttttttggtttctttcctt

SEQ ID NO: 400007 - DNA, 133 bp, Homo sapiens
ccattcttgaaatgtagccacctctggtgtaggatgttgtggaaagaaaaacaccacagtaacaggcgtttttgttattattgttaacgtttttgcctttgactctccctgattattaaatggagaaatcctt

SEQ ID NO: 400008 - DNA, 773 bp, Homo sapiens
cttgggccttccctctgagggacctgggagccaggcagggttttgagcaaagcatgctgtgatccgactcattgtgaaaaaggcctctttacagggaagctgagagcaacagggcggccagtgggaggaggggatggcaggggaagggtccaagcaggaggggtatcgaaagtgcctgtttgtgtcccaggcacacaatggcacacatacgttaccatagaatgacatcgatggtggtgataatgtcaaacgccacggtgccacatctcagggactgattctgaacaaccgtgactcccagattcaggatagcctcttgcattggggtcgtggcttcatatgagggtcactctcctcaccctgctgcctgcagagccaccaggggtcacactggcagattgcagccccagcagttaaaaaaaaaaaaaaaaaaaaaaaaaaaaaagaaatgaaagggagtggggaagatgggtaggaagagagagacagcaaatgcccccttcctcctgttctgatgaagttagggtatgaggggtacagagtgcagggaacacccaacagggacattatcatgccatggagcagctaatactgcttgagatcattcttcgtggtctccctgatgctctttgaggggtccccttgttgtctcgcagcctcttagtaccctcctgtcttcctcctccctccaagaaaggacaacttgacaacggcaggaatgaatgggtcggccgtctttcctcttgtctttctcgtcctgaagcacatcggat

SEQ ID NO: 400009 - DNA, 452 bp, Homo sapiens
cacacctgacagtcaacagctagttgggtggctgaggtgggaggatcacatgagcctgggaggtggaggttgcagtgagccaatattgcgccactgcgcttcagcctgggtgacaggagtgagaacctgtctcaaaaaaaagaatgtgcaagaataacaatagtatatgcatgagcaacttgtctgcccttcctgaaggaacagctccttccttccttccttcctttccttcctcttcctcttcctcttcctgtctttccctttttatttcttccttaagacagggtctcctcctgtcacccaggctggagtgcggtggtgtgatcctggctcactgcagtcttgacctcctgaggcgggagaatcacttgaacccaggaggcagaggttgcagtgagccaggatcgtgccattacactccagcctggtgacagagcgagcctccatctcca

SEQ ID NO: 400010 - DNA, 325 bp, Homo sapiens
ctaaaatgtgaaaatacttagataagacttcatttgaatttgacagagttatgtttttatcaggcatgttcatttaattattcaataaaataatttagttgacatgattgttagtgtgcagtgtttgtgtattatacactgggtataaatcaaactaatgaatttgacagagattgctgcataaaatgtgttactatgagttctaaacacaaatattgtactgtaaatattttaatctgaatgaattacatgttcatgtattcattagccataacatgttttttgaaattaaaaaggcaatatcatattactggcttgaaagacc

SEQ ID NO: 400011 - DNA, 368 bp, Homo sapiens
tcggcagttgacccttcaacttaaaaattaaatcatagaatattagtcagttgatggacaactgacatttgctttaacgaaaaaaagaggggtctttctcaccgaaagagccaaattattttataatatttttgttacattatgaaacaatagggaactatattctaagaaaaaatctcttaggaatttgatactgtaagtaactggacctaataatatcttttatgtataatttgtttgtaattttatgttgcacttctctgaagactgatgtagtttaataaaaggaatgaaaaatattatttttgaaaaatattcttcgtatttatggacattttaaattttgtaatttgttttaactaactttt

SEQ ID NO: 400012 - DNA, 356 bp, Homo sapiens
atttggcaagataaaagttttagttagaagaatagttggagcctgtgaaagctgtagggcaaaatggtataaagtgtgaaggggaacaatggacccctatgacatgactccttattccattagtatttgtttgatttcaacaagaattgcaaaataatacagatagggatggcatagaaaaataaaatcaaagttgtaaaactcaattttagccattctttctgttaaatttcccccaaaagacttttaatcaagctgttaacaagtagctaaatttatcaatttgagtcaaacctaactcaaacacatgagataatttatatttaagtaaccctttgacagaagagagctaacaa

SEQ ID NO: 400013 - DNA, 493 bp, Homo sapiens
tgccattttggctgtgctctcagcttgatcttccctttgtatctcttgaaaaggtgaaaatgaagttgaccaggtttcacaaatgccctcagggcaaaggccagctgcactccccactagatttctctttgggttcctctgtgccttcaaccctggcctgagaattccttatgtctcctcagttcattaatgcctttaagaatatttacactcgcactcacatggacacggacacgcgcacgcgtgcacacacacaccctttacttgctcagtttcggagcattgtccgatccttgtaagtgacttgccacatgactagaacctccagcttcatttcactccttctttccttcccctcccttttccctttatgccatcggtctgtattccacgatctttaaaatctaccttaagtactttctgggattatgtaaaaatcagacaactctcctagccaccatccttttctagagataggagtgactgactcctc

SEQ ID NO: 400014 - DNA, 699 bp, Homo sapiens
ccagttctgcagctccttcttgctttctgcattccagccacactaaccctgaaagtgtgttcttgcattttatcatgttccctgctgccacagggtctttgcaagggctatttcttcggcctgaaaggtggctccctccccctgtgcctgggtaactcctaccctccttgccataataggtcagatatactcccttaggggaacctttctcaaccaccctgaccagagcaagtgctccaatgatgtattttcacagcccacacctctcctttggatgacacattgcactggacactttgcatttatttgtataattatttgcatatgtctatgttccacacatgaagatagcagtgataactttctggttcatcaccacatatctagtgtctagcatggtgctgatacatagagagtactcaatagatagtatcaactgaatacacaaatgaatcacccgagttagggtgcaagtcatggctaacatcctcctcctgccccttccctggagcacgtacctcatgctgctcctcccactcttgagcacaatcccagttgcctctgacttacaactttgcatcacagtcgggcactgagatcaggagttttgaaaatggccaggagatcttctgtgttgactgcctctccactcatttgggctgctctaaggagcttgtttagtacctggaggagctataa

SEQ ID NO: 400015 - DNA, 523 bp, Homo sapiens
gaaacttcatattacaggtgttccatttcacagttaatggattatgaagaatgctgtgtgcagagtgttcagactgaggtgcagagattagcagatgtgtaagaagagaataactgcttaaagatgcggctcagatactgtaacccttagaatttcatggaaaactgattttcttgaaaaataatgcaaggtcaaagtccttttgtttatttattaggactctttgaacatgtctcatcggaattattggacttaccgtgttttaggaagtaacattctggagaaagctagggacacatggattaccttagccttcccactagactgtaatccccaagaggctggagagcacatccgtactgctaactgcatacctggcacagtgcctggcatacagtgttcaagtattattcaataatgtatgtggtagaatgattgacagataatttatgtggggaagatttgtgtttaaatgggagatcctgaaaatacaactcaatctctttttggtaaaatgtatggc

SEQ ID NO: 400016 - DNA, 516 bp, Homo sapiens
caatgagatggggtgaggttacaggcatcagcccattctaggctttgctcttcaacacatactgtcctcctgagccaggacgcagaccatggctacttttgcccctgcatgtctgttctgatttctttcttcatatgggatgtctcactattcttctgctttgaatatggagcttcagtctctaagctaaaaggccaagtacagattcacctgccaatgaagctctttaaattctctcttctttctcaggactcattggctgtaagtccatggagcaaaaacagaatttgctacttttcaatgacattgttttagttgagttgtgtttaactaacttgttgaatgaacggacactgtacattctccctgtaaaataacagtgtgttttctattatgcctatgtaagtctgttgcctcaaattgacgttatgttgttaacttatctaccagacagtttatttaggttgtattcaagttggtcttttgtgacataaataaaatcagggatgtgattat

SEQ ID NO: 400017 - DNA, 216 bp, Homo sapiens
gctgttagtcattaaaaacaaccttctttgtatataaacaagctcttgatgtttcaaaagaatgtatagtatttaaagctatatgtatttccattacccatatggatgagtatacatttatttaacctatttgagatgatccaattgaacaaaaacatttcctatcatttaagattttcttcaaaaatgcatctattaaacacattttcttgttgt

SEQ ID NO: 400018 - DNA, 612 bp, Homo sapiens
tacttaacctgagcccctggttcctcatctaaaacatggaattgatcattataagacctggctataagctgtaatgaggtgatccatgtagacaccttagggctattgcctgagacatggtgaccagcactcaggagacattagtgataaaccccacaaaacccattccagttattaagctcaaggaggccttagtactgttattcttcactacctctcagaatcaaaagtggctcatttagattgagaggctggaacagtccaaagctctcccagctaataagtgacaggactgaggctgcaacccagacatctgattcatgtcagcgttagttccactgtcacataagaaccacatgagtccttccatcatgtaacttatgagcctgttagaaagaggtggacagattagagagacatgtgaagggcctcctttttcatgatgggaaactgaagccttgggggagtattttacctactcaggagtattttgcacttgtgactacctcactatacccaggacagagaaagcccatagtgccctgtcaggccacaggggcttgctggctttttgtgtctttgcagcccccatttctgtttttgaaaaaaaaa

SEQ ID NO: 400019 - DNA, 886 bp, Homo sapiens
tacttaacctgagcccctggttcctcatctaaaacatggaattgatcattataagacctggctataagctgtaatgaggtgatccatgtagacaccttagggctattgcctgagacatggtgaccagcactcaggagacattagtgataaaccccacaaaacccattccagttattaagctcaaggaggccttagtactgttattcttcactacctctcagaatcaaaagtggctcatttagattgagaggctggaacagtccaaagctctcccagctaataagtgacaggactgaggctgcaacccagacatctgattcatgtcagcgttagttccactgtcacataagaaccacatgagtccttccatcatgtaacttatgagcctgttagaaagaggtggacagattagagagacatgtgaagggcctcctttttcatgatgggaaactgaagccttgggggagtattttacctactcaggagtattttgcacttgtgactacctcactatacccaggacagagaaagcccatagtgccctgtcaggccacaggggcttgctggctttttgtgtctttgcagccccctttaaaacctgacgtgcagtacacgtgagcattctagaacctgctataccagggcttagccgacagcaggccaagagtaggaacaaagcaagaaaacgttccgtggggagacttgagctgggaattagggtgttggtgcccctagtgaagacctagtgggcatctgtaggccactgccacctctgcttttggccacagtgccactcaggcagtggcctccattcacccaaagactaagtaacttgcccttgattacactggtcttttgtgtccagggccaagtatctgctcaggcc

SEQ ID NO: 400020 - DNA, 235 bp, Homo sapiens
ctctttccctggaactaaggtgaagaaccatgagggaaggaaacggaagcataggaccatgcagcagtcctcaggccagtgatggacactcccttgactcttgtgtccattcttggcttttctttttctatggctccttcctagggagatttctctcccatctgtgacccagttgggagtgggaaactgtgtccaccatgccagcagattgccaaggcctgccgctgctgcacag

SEQ ID NO: 400021 - DNA, 413 bp, Homo sapiens
attttcaaaggcgggagctgaagtggtgtgtttttaaaagcaaggtacagaacagacaatgctatcatttggttttagaaaatctatacgtgtttgcttctacatgcatggaatatctctggaaggatatgcaagaaactggtaatagtggttgcctctgggaagagaactaggtggcaagcagacagagggggagggagatttgctttctctgcatcccttttccatctttgacttttgtaccatgtacatgagatgcacattcaaaaaataaataacagtctggttgcagtggctcaagcctataattccagcacttcaggaggccgaggcaggcagatagcttgagccccaggagtttgagaccagccatggtctcaaactagggcagcatggagaaaccccatctctat

SEQ ID NO: 400022 - DNA, 945 bp, Homo sapiens
gcacaagcaaccctatgagaggtgaattattgttatccaaatttaaagatgaggaaaatgaagctcagaaatgtgaaatgacctttttagtattacacggaagatctgggactcaaaattaacaggctattatcaagaacatttatgaagggaccacattatatatgacagcgttggatgtccagtgaattttgcatgatacggagttgaattagtccctggcttcaaggactttcctttctcttttatcccttctattctgttcacacttttcttctagatactggaactataagcccaaaactacttaacatgaaagactttaggtacacgattccccactggcagctgctttaatggtgaaggatttcttgagtactagcagaaaacataatatataaagagagttgtgtgctagacaaatggactaagaaaccatgatttcttggggttttgttcttgctattttcaagctaaaatgcacccctgggattgcagatggtcataagaaaaattatcaagtgaaaagttaaccactgccaaactcatatgattgaaaattggccattgttatgtttagaatattttttgtgcatttgcaattaagaataaaaagtcagaatttaaaaatgaaaaaaagaaaagaaaaagccacttcaccaaacatttcctaaaattcacagattcccaggggtttgaagacagtattcccaatttggaatgtagtcctgactatcccaaggatcttggaatctcagggttagaagggatcttaaaaatcacccattttaacctcccctcaatgcaggaattctctctaaagcctcctcaacaggcggccaacccccatatccgcctgaatgcttccagagaaggcgagtcgaatcctttgttggacagccctgattgtttttcctgatgttggtgatgggccttgagaaaaag

SEQ ID NO: 400023 - DNA, 305 bp, Homo sapiens
tccccacacccacagcacacagcagaggctcaacacaaagtagccaggcagtgctgctcccggacagacatgcctgagggaccgtgctcagtgattcaggagtggtccagatgtgggaaggcagccacgcttggttgggggcacaggacgtgtgggggctggggtccctgtgccgcagggtgggcgtgagtgggcgctgagttctactacctcctccctcagctggtgcctttaaaggagggaagccatggggcagtgggtctgctctgacccgacaggcaggagtgaaggggaagggaagggaa

SEQ ID NO: 400024 - DNA, 458 bp, Homo sapiens
  misc_feature (36)..(36): n is a, c, g, or t
ctttatttcccccccccaattcttattttatttttntgagatgttatgcaacggcatggacaatgatgccggttcagaggcccagccgagacaatgatgcacagggaaactccctcgagccccagctgtcacctagtacttcgaagacactgagagaatgcatgttgcctggtgtgcaaggaaaatggtgtggattgttcattcatcagcaggagaatgtaacatgcatacattggatgcaacagcaaaggcagaaggcatctttaaaaattctgaatttgccctttcactaaagacagatttatttttttaaaaaagtacctctggaataacgttaaattgtaaaatgtggctcaacttttcaaatacttacctaattaatacacatagttagatcaagccaaagggtatattctaataatatgactcaataaagcaacttgatatgacttcttctc

SEQ ID NO: 400025 - DNA, 457 bp, Homo sapiens
cgtcctaacaacgcgcagacccccgcgttgtaatacccccccttcagcaacggcatggacaatgatgccggttcagaggcccagccgagacaatgatgcacagggaaactccctcgagccccagctgtcacctagtacttcgaagacactgagagaatgcatgttgcctggtgtgcaaggaaaatggtgtggattgttcattcatcagcaggagaatgtaacatgcatacattggatgcaacagcaaaggcagaaggcatctttaaaaattctgaatttgccctttcactaaagacagatttatttttttaaaaaagtacctctggaataacgttaaattgtaaaatgtggctcaacttttcaaatacttacctaattaatacacatagttagatcaagccaaagggtatattctaataatatgactcaataaagcaacttgatatgacttcttctc

SEQ ID NO: 400026 - DNA, 479 bp, Homo sapiens
cgggttcacagggctgtgaggtgcttcaggcagagagtaggggtaagataatcagtggaggtaagaggacataaaatacctgtaacccaacgatgtagggtcatgagattgtcttggctcagtgtgagagagaggtaccaaaggtcatcttcctaaaatttaaaagacaataagattgtccagggtccggccaggcgcagtggctcatgtctgtaatcccagcactttgggaggtcaagctgggcggatcacttgaggtcaggagtttgagaccaggctgaccaacgtggtgaaaccccgtctctacgaaacatacaaaaattagtcgggtgtggtggcacactcctgtagtcccagctactcaggaggctgaggcaggagaataattgcttgaatctgggaggcggaggttgcagtgagccgagatcataccactgcacttcagcctgggcagcagagcgagactctgtttaaaaaaa

SEQ ID NO: 400027 - DNA, 465 bp, Homo sapiens
gttgctgcgaaggacattatttcattcctttttatggctgagttgcattccatggtgtatatgtatataccacaatgtctgtatccactcattgattgatgggtatgcaggctggttccatacttttccaattgcgaattgtgctgctataaacatccatgagcaatatctttttggtataatgatatgttttcctctgagtggatacccagtagtgggattgctggatcaaatggtagttctacttttagctccttaagtaatctccacactgtttttcatagtggtggtactagtttacatttccaccggcaatgtaaaagtgtttcttcctgtccctctggtcatctgtttttttaagggatctacctaaactcaaccataacccattccatccacctcatcttgcctcaagctaagaaataggagtgcagagaagaaaacagtacagataagaatgctaga

SEQ ID NO: 400028 - DNA, 523 bp, Homo sapiens
ttgacttctctgagattagctgtcttcagtttgacactctaatgtcttggtcttactcttgtacagaacttactttttattcctctagatcaggcctcagtttgtggttgttcagtaatagtagtaatagccaacatttattgggtattatactgtgcagtctaagagctttataaatgctagccttttatccatcatggtttccttctcttatgtcagaaatgtttttaaacctagaaaaggtaaagtaaatgagacgtcattcctcattgatcagtgtaagctcattccatccaatctcgtgatatttttctctcaagcacaatcagaatttagatttattattttgaaaactagctgtagaaaactaatgcagagttcctattccttcatctactattaaatagggactctgctttcaagtataagcctagcgtgtttttctgacaaagtaagcctcctggtttctaaaggaactaaaaatcttttctaaatgatatgaaacccatgacgtgaagcacat

SEQ ID NO: 400029 - DNA, 220 bp, Homo sapiens
aatggaaaatggtgttaacagacaatgcttcatggacgacagatatgcagtctgtccatggaactggcgtctgcccataaagacacagtctaggccactttaacatctccctatcctggtcctcttggctcccaggaccaatgtggtatcccacttctctggcatggagctctgccctcagattcctgagcatcaagctcagtggctcttcacccaggca

SEQ ID NO: 400030 - DNA, 597 bp, Homo sapiens
gttcattctatgatctttaatacatcagttattcattttgagacatgttgaacaaataaattaggatacagcaggaatcccatcttttgaagaattcattggtaatgggacagagaagtcagtaattcaaaaacagcagaactgttaaaatttcaagtctacttaatttgtttactaaacaggctgtaatccatctcggcacactgtaacctctgcgtcccgggttcaagcagttctcctgcctcagcctctcgtgccgaatttggcacgaggaaatgcctagtcaagtacgcaggccacgtgggctcagtaaattctatcaaatttcatccctcagagcagttggctctcactgcttttggagaacaaactgctcatatctggagatacgcggggccagttgccacacccccaactgttgctgacactagtcagatatctggggaagaatgagtttagtgctcttacaaggactagccccaccttgatggggatgtgtccagcgacttgcccaaccattcgggtcccacttgcattcctcaagagccaccaggggcgtgggtaatagccttcccttggttggtttggggggctccc

SEQ ID NO: 400031 - DNA, 921 bp, Homo sapiens
ccaaagtgcactgtctgtgctgtcagcccacctgtggctgggcttgcaggggtgatgtgggctcaccctacaacaggcctggactagaacacagagtggtccatggccttctggggttctctgcgcttgagcactgacccatcacaggggacagtaaccaggttcacggtaaaggctggtggctctgttatggagattttggtggctttaccttcagcaaaagctgacatgctgcccactatacaaagttcaggtagaacccttccttccctaagttctcagagtaatggagttaacagactactagtttgggagccaactgggacttaggtcggcactgctcttagttaagggtccctgggccaatcactgaccttctctggccccacattcttctggtgtggaatgaggtattgaactaaaacaaatcttgaagatcccattcaacattctatgtatctaattaagctggtgtaaaccacttttcccactcccaggtttctctcttgggatctttgagcttctgaagtcaagtaagagtcttttcagttggacctacccataccaccatcattcaccaccaagacaaagggtccagtggggctgggtgcagtggcttacgcctggaggccgagactggagaattgctcaaactcctgacctcgtgatctgcctgcctccaaaagtgctgggattacaggcgtgagccactgcgcctggccctcttctgtctcacagcaaagttcaactcttatatgtagttatcattttagaaagaaggaaacttaggtccagagatctgaagggtgtcttgttggccagtcttgtgcttctgaaagtcatgacagcagaggagcaatgcagtcctcccgcccttgactgggcaactccaaggctgcacctattaacagagctcgaaga

SEQ ID NO: 400032 - DNA, 497 bp, Homo sapiens
ccaaagtgcactgtctgtgctgtcagcccacctgtggctgggcttgcaggggtgatgtgggctcaccctacaacaggcctggactagaacacagagtggtccatggccttctggggttctctgcgcttgagcactgacccatcacaggggacagtaaccaggttcacggtaaaggctggtggctctgttatggagattttggtggctttaccttcagcaagttctcagagtaatggagttaacagactactagtttgggagccaactgggacttaggtcggcactgctcttagttaagggtccctgggccaatcactgaccttcttcttatatgtagttatcattttagaaagaaggaaacttaggtccagagatctgaagggtgtcttgttggccagtcttgtgcttctgaaagtcatgacagcagaggagcaatgcagtcctcccgcccttgactgggcaactccaaggctgcacctattaacagagctcgaaga

SEQ ID NO: 400033 - DNA, 1633 bp, Homo sapiens
ggagaatcactttagcctgggaggtcgaggccgcagtgaagggtgatcgtgccactgcacgctagcctgggtgacagtgagaccctgtctcaaaaaaaaatgttttagatgaagagattatttcattttttgaaggtggtacagcagtgaatacatttctggccctactgtaaacaagaaaattcaggctatcagtatgaacttaacagaatatattacaacatttattaactagatgtatggtggtttattaccaagtcaacaggtataaaaggagtaacagtggggtttgttggagaagaggcaaaaatttctgtatggtattaattgcaacttgagtagtttggaggcttcaacagtttgacaatgatttctgttccatactacatctattcctgttttacttctttgggattactacttccctcttttaaaactcctcacattccctagcttgccccttctcccaaaagatagggtgggtaaaacaagcacaaaactgttaacccttgatcctagtagcagttctaggaggcagcctccctctaaagctaatatcaatattctgtttaaaacactcatttaatttgatctcatctggctcaaaatttcttgtgctcttagtgtaaattaagcagtgaatattctttaccacacttagaatgtgacaatacacactggtgtccagttgattaacttggatccattcgaggaaattctagagtccatgtcattacagaaattgcctgtatttttttctagatattgttaattattaatctgtattggacttttaaggggcttgtattataaggactggctataaacaggtttttatttgaattaacagaggtttcttttggcttccttttatttaggtagcggataccccagctaagtgcttgttaatttagttgataactatatcaaaatattattctgtctctgtacacagtggatgaaaggttctagaattgtttcaacaatgtgttaggttggtgcagtttttgcacccacctcaaaatggcaaaaaccacaattacttttgcaccaacttaatttagcagcaggctttccaattagatgttttcctaggtgtcactgagggccgaacttggaaacagtgcattcactatgctgttccccacactggctagaattgttcttgtaataggtttgctaccatgtatgtagacataataaagtggattatgacaatagccctttttccaatattgtaaactctttttaatgtagttataaatatattagcaatgaatttaaataatttaaaaagcttcaagatgagcgtactgtttcttacagtttggaaggaaggaggcagtttcagatttgaaacatctttagtggttttctagtaaatgatgtatgtaagttctgaaataggttgttcctttgtggttttaaaagatttacataatagttctagaaagttcttggatcttatgaaagtgttagcatgttatttcataattaagaaacgtgaattgtaaataccatccagctttttattataccagaatgatttagttgttttcatagaatttatactttatggaccaattctccccatacctagtgactttaaataaataatttaaaatttaaaaaa

SEQ ID NO: 400034 - DNA, 391 bp, Homo sapiens
aagtctagtttctctggtgccatggcttggagggtcacgcctgcagtcatggccagcacatttaaatgggtgccaggatccaggaaccagggaaagaaaatagttgggggaacgccccctactgtgttctccatcctggatcacatactgaaaggaaggagactaaaataatgcttttattctcacttctctttctagatgggtaacagatcgtcttctctgcactccaacctgggtgacagaatgaggcttcatctaaaaaaattaatataatgaatcacattaatagaataaagaagaaaacccacataatcatgtaaacgcacaaaaaccactatctgaaatccattacttttcatgataaactaggaattaaaaggtgcctataagc

SEQ ID NO: 400035 - DNA, 270 bp, Homo sapiens
agtgttcctccagtcatcagagccataccattttgttgcattggccgggaatccaaggtacgacactcatcggagtgatgggtaacagatcgtcttctctgcactccaacctgggtgacagaatgaggcttcatctaaaaaaattaatataatgaatcacattaatagaataaagaagaaaacccacataatcatgtaaacgcacaaaaaccactatctgaaatccattacttttcatgataaactaggaattaaaaggtgcctataagc

SEQ ID NO: 400036 - DNA, 453 bp, Homo sapiens
gtgacatagactgtgaccattttcttccattatttcagtctcacatctggaaagagaacattctatatccgagatttttagttaaaaacctaagaaataggatattaatttttcttgtctgaatcttatgttttatccaaaagtttggccacaaatttccagcacattgctgaaaccagaattcttccagtgactacttttgtgaaggaaccaactgttttcataaatcaagcttaaggagttatgagtctaataatcatcattattgtcatcattccagatcttcatggaatgctactatgagctgaatgggatgcctgagatactgcctctaggaagcaaagtggctcaaggtgggaaggacttaataattcataaaaatcaagctcttctctttactatagatagggctgatgtgtcacattgttaaagtattaaattggtatgcatcag

SEQ ID NO: 400037 - DNA, 1446 bp, Homo sapiens
gcagtatctagagttaacagtaggggatttatttttcaatctaaagtttttcacctctctctagtaagacatctgaaactcataagccatctttaagaatttcttacaaaaacatgctggaagacagtggatcttgtttgtatcctgaagatttttttctcttcgttattttaaattaattgtcaacagatgtgcaactgttaggttggttcttaagtcactcggagaagagagagatgcatctactcaaggttggcacttggagaaacaacactgcctcttcctggcttatgaagttcagtgttctttggcttgttagtcagaactgttgcagagcaagtgttgtttggatggcttatatgaacatatcatttcatgttgggaatcatgtgttgtcagagttgggagagactggagtctttggaagaagctccactttgaagagagtggcaggagttatagtgccaccagagggaaaaatccaaaatgcatgtaatcccaataccattttcagccgatcaaagtactcagagacctggcttgcacttattgaacggggaggttgtaccttcacacagaaaattaaagtggcaactgagaagggagccagtggagtgatcatctataacgttccaggtactggcaaccaggtgttccccatgtttcatcaggcatttgaagatgtcgtgtggttatgattggtaacttaaaaggcacggaaattttccatttaattaagaagggagttctcattacagccgtggttgaggtggggagaaaagcacatcatctggatgaatcactatttggtctcttttgtgattgtcacaactgctaccttagcatatttcatcttttatcacattcatagactttgtttagcaaggattcagaaccggagatggcagcgattaacaacagatcttcagaacacatttggacaactccaacttcgagtagtaaaagagggggatgaagaaataaatccaaatggggatagctgcgtaatttgctttgaacgctataagcctaatgacatagttcgtattctgacttgtaaacattttttccacaagaattgcattgacccctggattttaccccatgggacatgccccatttgcaaatgtgatattcttaaagttttggggattcaagtggttgttgaaaatggaacagaacctttgcaagttctaatgtcaaatgaactgcctgaaaccttatcacctagtgaagaggagacaaataatgaagtttctcctgcaggaacctcagataaagtaatccatgtggaggagaaccctacttctcagaataatgacatccagcctcattcagtagtggaagatgttcatccttcaccttgatggcatgacttttgaggaagtgtattaaacctgtatgtgaaatcaggtcctaatactgacaagcagtttgtctgtttga

SEQ ID NO: 400038 - DNA, 415 bp, Homo sapiens
gaatatccactagggatctcattctgtcgcctaggctggaatgcaatgcgtccctgaccttgcttcatatacacaacatcctttcttatcttctgaagatatgaatgaaagtgaaagttgacttcaccacaggcccaggtcttgtattgaggacaaggaaatactgccccataatgctgttgagaatatttaagagcagtcaggaaaccctttgtagcttggctttattgcagcaagtgtcaaagaggaggacctgaacttccaaggccaacttgactggaaaccctctagtctttaatccatagaaacctgacttctgtgccccccatgcctagaaaactacttttaaaaagaacattagtggtcaccacgttggtaaagtattaataaataaacatgttttagttctaatcat

SEQ ID NO: 400039 - DNA, 292 bp, Homo sapiens
gaatatccactagggatctcattctgtcgcctaggctggaatgcaatgcgtccctgaccttgcttcatatacacaacatcctttcttatcttctgaagatatgaatgaaagtgaaagcaaagaggaggacctgaacttccaaggccaacttgactggaaaccctctagtctttaatccatagaaacctgacttctgtgccccccatgcctagaaaactacttttaaaaagaacattagtggtcaccacgttggtaaagtattaataaataaacatgttttagttctaatcat

SEQ ID NO: 400040 - DNA, 978 bp, Homo sapiens
atttctccctctctctctctctctctctctctctctccctctccctctccctctctcatttcccctcactcccctttcacagttgacttcaccacaggcccaggtcttgtattgaggacaaggaaatactgccccataatgctgttgagaatatttaagagcagtcaggaaaccctttgtagcttggctttattgcagcaagtgtgtatgtgctatttatactggcctatttttatatttttgttttgtttttatattttcatgtgtttttatatgtttttatgttttgttatattgcagcaagatagacatcataatattcattataaatacaaaaagaaaaatgaggagaaggagggagaggttggggtaagtagcaaagagaaaattcaaataggatttgactattagagttaagccaccagagcccgggtgctccaggtgagctcagcctttcagccatccctggcaaggcagcagacacacaggatgagctatcttggggtctccagaccagttcatccagcagttactaaatgacctctgtggctgacgtgtagaatggacaaatcgcccagccacactcagactgaattcccccgtctgggagcccatgcactttccaaaagattcccatgatagttatgggagccacaaggaaattaaccaagctagaatgcccagtctcttctctatgcacacgaagagcatcttatgccctcaaatataaaggctcccaacagcacgcccttatgttatttcccaaatatacgtatctgaaatctatacttggtgtggctagccgaattgcctattcatgccatcggcccaggggaagcatactaccccttccacagaatttctatgcccatcctctcctaacgaatcgcaaggaacacattgcatagttacgcctatcgacgcattgcagagtaaccccatccgttcgctactctaggataatctctacgtaccact

SEQ ID NO: 400041 - DNA, 375 bp, Homo sapiens
tacccatttctttcctgcaggtttttactgatttggaaggttatgcaatcataacctgcctacccgtgttctgctccaggtagacaagggaatcgctaagaatccaaacttcattctatcatccctaaacagagctggcgaggctccccgaaggcggttacaacatccactgttcctttatctcttagcaccacgctctgtgttcacgggtcacccactactgctgcacgctttcaagctgctacacacagagccccggcaaagagccgacggtgacaaagagaggagcgtcacatacaagagcgtctgaagaaaggcagaaagatggcctgacgacttaccaaaaagccttggggttggacataagacaacaag

SEQ ID NO: 400042 - DNA, 312 bp, Homo sapiens
ctggaagggcttgctgaaaggtttgcaaaacctatttgcaaaagggagccattggaagttttaaagtagggtcttggcacattcacactattgtttaaaaagctactcacagacctgtggtagatggtttctggaagctgggacgccagctggggccttgttgggttaccggcagaggcgaggtggcccttcccaggtacagatgagtgccggttgcagtgagagtcgaaatcaggtgacaaatgtaagggacacagagagcagaatgtcagcagggcccggtgctgtctggatgtggcacgagtgggagag

SEQ ID NO: 400043 - DNA, 357 bp, Homo sapiens
agaaggctgttggatgctttagatatttttaaaggtgacttcctggaggcagcattgtaggagctaagaactcagactggccaggtccagtggctcacgcctgtaatcccagcactttgggagactgaggcgggtggatcacgaggtcaggagttcaagaccagtctggccaacatggtgaaaccccgtctctactaaaaatacaaaaactagccaggcgtggtggcgggtacctgtaatctcagctactcaggaggctgagtcagggaattccttgaacccaggaggcagaggttgcagtgagccgagatcgcgccactgtactccagcctgggcgactgagcaacacgtgtctca

SEQ ID NO: 400044 - DNA, 432 bp, Homo sapiens
agtgtcagagcctttacgtggaccttcccatggaaaaggaaacagaatagtcaatggaaaaggagaagggcctcctgcaaaacatccttccttgaagcctagcactgaaatggaagatcctgctgtgaaaggagcagtacaaaaaagaatgtacagacattgagagcagtgttgatttacccaatactaatgggaaccattgagcatttgccttgtggtgtctcctcagctgtattcacacattccatcaccttgtcttaatggataatcatgcactaacaagccttaccagtggcttcagaggaagaacagcaaaggcgtgaaagaagtgaaaagaagcaaccacagctaattttagaacatgcattctgacagaaaagacatctgagaaacaaaacaagcaaatttgttttccattttgcacctgccaaa

SEQ ID NO: 400045 - DNA, 814 bp, Homo sapiens
agtgtcagagcctttacgtggaccttcccatggaaaaggaaacagaatagtcaatggaaaaggagaagggcctcctgcaaaacatccttccttgaagcctagcactgaaatggaagatcctgctgtgaaaggagcagtacaaaaaagaatgtacagacattgagagcagtgttgatttacccaatactaatgggaaccattgagcatttgccttgtggtgtctcctcagctgtattcacacattccatcaccttgtcttaatggataatcatgcactaacaagccttaccagtggcttcagaggaagaacagcaaaggcgtgaaagaagtgaaaagaagcaaccacaggtcatagaaggaaataatacatacaaaagtgaaaaaatacaactatcagaaaatatatgtcatagtacattttctgctgctgctgacagattaacccaacaaagaaagattgggaaaacatatcctcagcaatttcccaagaaactgaaggaagagcatgatagatgcaccttaaaacaagaaaatgaagaaaaaacaaatgttaatatgctgcacaaaaaaaatcgagaagaattagaaaggaaagagaaacaatataagaaagaagttgaagcaaaacaacttgaaccaactgttcaatcactagagatgaaaccaaagactgcaagaaatactccaaatcaggattttcataatcatgaagaagtgaaagatctgatggatgaaaattgcattttgaagacagatattgctatactcagacaggaaatatgcacaatgaaaaatgacaacctggaaaaaaaaa

SEQ ID NO: 400046 - DNA, 328 bp, Homo sapiens
gcttcggccagacccgacagtcagtgctcaatgctgcttctgtcactgcctgaaacaaggcgtggtgaggcaggcggagaagtcaattctctcgcttctggaaaacagcttcaaaaaagcactgattcattgctgctcctctcctgttcacaccgggacctgtgaggcactgggagtccgtgggaaaaataaagaaggggaaaccccacaaagaaggcggctgttcctcttggaggaagtgggagagctgtccctgtgccctctttacgcgacacgatcaaagcgtaaagaacatccctttaatccttactccaggtcctgggtagaa

SEQ ID NO: 400047 - DNA, 425 bp, Homo sapiens
caaaaaaaaaaaaaacaaaacacacccagaactttcagcctaactggccaactgtaagcttaatgcaactcctttcttatgcaagaagaagctagagtggccatcagtatatatattagctaaaatatatatatatttttagtactaaaaaccaatgtccttgttggctcatgcctgtaatcccagcactttgggaggccaaggcaggaggattgcttgagtccaggcaggtgttcaagactagcgttggtatcatagcatctctacaaaaattaaattagccaggcatggtggcacatgcctgtagtctcagctactcggaaggctgaggtgggagcatcacttgagcccaggagtttgaggctacagtgagctctgattgtaccactgcagtctgcctgggcaacagagcaagacccactctc

SEQ ID NO: 400048 - DNA, 738 bp, Homo sapiens
attgaaatagataaaatgaatttcttttctagataacaaaggaggtgtcataaaacacttgttatgggccagtgtgatggctcatgcctataatctcagtgctttgagaggctgaggtggaggattgcttgaggccaggaatttgagaccagcctggggcaacatagcaagaccccatctcttaaaaaaaaaagggtggggcgggggggcactgctgggcgcggtggctcatgcctgtaatcccagcactttgggaagccaaagcaggtggatcaaaaggtcaggagttcgagatcagcctggccaacatggtgaaaccccaactctactaaaaatacaaaaattagccgggcatgatggcgggtgcttataatcccagctactcaggaggctgaggcagaagaattgcttgaacccaggaggcggaggttgcagtgagcagagattgcaccactgcactccagcctgggcaacagagcgaaactctgtctcaaaaatgaattaattaattaaaacaattactggccgtcgtttacacgtgtgactgggaaacctggcgtaccacttatcgcctgagacatcccctttcgcagttgcgtatacgacaggccggccgatcgccttccacagtggccaccgaatgcaaatgaaatggagcgtatatttgttcgcgtaatttgtaaacattcattttaccatagccaatcgaaatccttaatgataaccggggtgggtgct

SEQ ID NO: 400049 - DNA, 1832 bp, Homo sapiens
tctaagtcattaaggaattgccacactgtcttccataatgattgaactaatttatactcttgccaacagtgtaaaagtattcctttttctccacaatctcgccagcatctgttattttttgactttttagtagtagccattctagctggtgttagatgatatctcactgtggttttgatttgcatttctctaattatgaagttaataatttcataattttattaaatttgatgaaatcaactcaagatggattacagacttaaatgtaaaacccaaaacctaaaaatcctagaagaaaacctaggcagtactatgcaggacataggcattggcaaagatttcatgatgaagacaccaaaagcaattgcaacaaaagcaaacatggacaaatgggatctaatcatactaaagagcttctgcacagccaaagaaactaacagagcaaacagacaacctacagaatgggagaaaatttttgcaatctgtgcatctgagaaaggtctaaaatccagcatctataaggaacttaacaaatttaaaagaaaaaaaaaacaacccattaaaaggtgggcaaaggacatgaacagacacttctcaaaagaagacatacatggagccaacgaacatataattctttatatacactgttggatatgattttttaagtattttgtcagagggtttttgcatttatgttcatgacaaataccagtctagttttcttgtaatggcattgtctggttatggtattatggtaatgctggaatcactaaatgagttaggaagtattctctctaattctgtcttctgaaagacatggtagaaaattggcataatttcctccttaaatgtttggtagaatcgccagtgaactcatctaggtctgatgctttctgttttggaagattattaattgttgtttcaatttctttaatagatattgggctctatattatctgtttcttcttgtatgagttttagcagactgcatttcaaggaattgatttatttcgtctaggttaacggatctatgggcatgaagttttgtatagtattattttattgttcttttaatatccatgggctctgcagtgcagtgatgcccccctttttcttttctgatattattaatttgtatcgcttttttttcttagttagcctacctaaagacttatactttttattgatcttctttaaagaaccagattttgattcttttgagttctgtattgatttcttgttttcaatttcacgggtttctgctccaatttctattatttctttttctgctaactttgaatttaatttacttttctttttctagcttcttaatctggcagcttagataattgattttagatctctcttctaatatatctatttaacgctatacatttttctatcagcactacttttgctgcatctcacagattttgataggtagtattttcagttttatttagcttaaaatattcttttttatttctctcgatatttgttctttgacctatgtattatttagaaatgtattgttgactatccaaatattttgggatttttcagctctttttctgtcatcggtttctagtttaattccactgcggcctgagggcatacattgtatgatttctattattttaaacttattaaggtatgttttatggcccagaatgcgatctaccttggtatatgttcaggacaatgttttgaaaaatactactagatagttctcttcataatgatttacctacttgtcttagtctgtttgctgttacttacaacagaatacctgaaatggggtgatttatttaaaaaataaatttatttcttac

SEQ ID NO: 400050 - DNA, 204 bp, Homo sapiens
ccgcatagatgtacggcttccagaagagcggcggcacctcagctcgatccaccgtgaagacaggctctggctgcagagatagctgaggctcctggatgacctgccgcagactcggcaggaggtggctgagtttctgggccatggccatggctgtgggcctgggcagggagctgggagagagaccagagcaaagtcaggggcctg

SEQ ID NO: 400051 - DNA, 478 bp, Homo sapiens
gggttcttatcctttacctctattatgtgggatcttgggaagcaggaatttttctggttcccttcccgattcgattgacctaggaaactagattaaaaatcaaaaagttacttggtgagaatagaattagataaaaaggagaggagacagtttttgaggctattttatgaatgcctctccttcctaacagctgggtgacatttctctgtcacatagttcattcattcaacaaatattttatttttatttatttatttttattttttattttatttatttttttgagatggagtctcgctctgtctccaggcagagtttgcagtgagccgagatcgtgccactgcactccagcctggggaacagtgtgagactctatctcaaataaataaataaataaataaataccttatgtatcagaacatgtcaaaaaaggcaaaaaataaaaaagagaaaagaattttacattgtattctctaaa

SEQ ID NO: 400052 - DNA, 299 bp, Homo sapiens
ctaacatggtgaaaccctgtctctactaaaaatacaaaaaaaaaaaaaaacaaattagcagggtgtggtggcgggcacctgtagtcccagctactcgggaggctgaggcagaatggcatgaacctgggaggcagagtttgcagtgagccgagatcgtgccactgcactccagcctggggaacagtgtgagactctatctcaaataaataaataaataaataaataccttatgtatcagaacatgtcaaaaaaggcaaaaaataaaaaagagaaaagaattttacattgtattctctaaa

SEQ ID NO: 400053 - DNA, 1114 bp, Homo sapiens
aagacattgaggacgtaacacctgtgttcccccagctttccaggtccatcatctctaaattgctaaatgaatcagaaacaaaggtccagaaaactgaggtagaagatgcagatatgcttgagagtgaagaatgtgaagcttctaaaggctactatctcactaaagccttgactggacataacatgtcagaagctcttgtcactgaagcagagaatatgaaatgccttcaattttccaaggacgttattattagtgacacaaaagactattttatgtcgaagactcttggcattgggagactgaaaaggccctccttcttagatgatccactgtatggtatcagtgtgagcctttcatcagaagaccaacatctgaaactcagttctccagagaatacaatagcagatgagcaggagactaaagatgcagcagaagaatgtaaagaaccctaatcaaggacttgctgggtgtgcttttcagaaagttggtaatgaagttaaattaaatttcttattgaattatttgaattcaatgaatgcactgcagagactattctttattgattttgacatttggagtcgctctttgtggattatatttccttgatatttttgagacttggggtgtaattgttcagtggtttttgctcattaaaatttctgggaccattgtttataaatttattgctaatcttacagtattaggattcattataaaaaccaacattttaatgtatacgtgttagggtaaaactcgttgaagtgctgtgattgtcctgtattcaattttgtatgtttcacctctactgtgattcagacagatcatggtggtcactgggaatttttgctgtggccctgcttttccttcttcccacttgtctcatgtctgtgaaactggtacaacctgccataagatgaaatgaattgtctcaacaaagcaatattagaagagcctttactatcttattggtgatgacacgtttcttaagtaggagtttgagtgaattatttgatatattactttgttaataatagttaacaatagtttcttattttctttcagagtttgggccttttagattgcatcaaataaagatgagctactttaaaagaca

SEQ ID NO: 400054 - DNA, 493 bp, Homo sapiens
gaaactggactgtcagcgctctgagggcagggactgctctgtttaaaccacgactgcacacacattttcctaaagcaagctaattgcagacttaagcctctccgaacagcttacatgacacccaaacatggacccacaatacattttgtgtcgcacaacatcaagtcacacaaaaatctcaaaattatacattacaatacaatttaattgtgctgtggtattaaagtcaaagacaaaggctttaaaccgagtgcctatgaggtaaccacagtaaagtcacacctttaataataagggaccaagaacacacgggatggcaacagggagtgagtgtccagcagagccctagacggaactggcgcaaccgctccagatcggaattcgaacccagaacttctggcgaaggccatgtaagaactactccaaggaggaagaggcctttacggccaggtgcaccttgctggaactttctgccggaggggaccccctcccc

SEQ ID NO: 400055 - DNA, 296 bp, Homo sapiens
tgccccttgcaagccttgacccactgccactacaatgtcacctttatagttctgagtcttagaaatctcttctctctctaggacctggctaaactcttgtgatcaaatagaaatggtcaaccagcaaatgttaccactagtttaaaaaaaggttccatcttgcacctggtagataatctacagtggtttgtcaaactgaatttattgcagtgtgtctacattaaaacttgccattcagaagtggtgtgaaattgggtacccaatccttggcatcctgaccgccctcctgtcagatt

SEQ ID NO: 400056 - DNA, 360 bp, Homo sapiens
gctgtttcttttttattcacacagatatgaggatgaaatcaataaacgtacagctgctgagaatgaatttgtgactctgaagaaggtaagggctgtgtgtgaggtttctgaggcttgcagctgcaggtttctggctgggttgggggaatctcctcactccactgccacagagctgccaagttcaggcctttggagcaataaacagaagtcaggtgcaccttagtctggaagatccctaaaagagttagttcatcagtctttagttttttagtaggattaaacttagaccatcctaatgagatacaaattgcccgttcaagtggagactggtcttagacaaggaccatcactgcaccagtc

SEQ ID NO: 400057 - DNA, 499 bp, Homo sapiens
accatgcgggtggctgtcacttgaaaatttcccgtgcattcctggaggtacctgcccctgtctctcaatcccctgcaaaaggagtcggagccgggggctccaggcgtttactccaagattcacatgcgtcttcccatgtcccagctgcctttgccgctgtcgatgcagacacctaaaaaggaggatttttccaaccccactgggagccccgcctctgcctctccacccgttccgcgctgaccctccaggcagcgcccctggttcgtctgcgctgtcctttccacctgacaaaagctggggcggcggggcgcggcgccgggcgacctcacatttctgccaaaggagagagacgcgtgtccgcggtgcgcccattcggggcctctgcaaatcgaccgagctgaggaacaaagcggccagcgcgcggcgagacgcagcccccacggaacccccgagcgccccagccctcgccgtcccggcccagccccccgcaagcggccgc

SEQ ID NO: 400058 - DNA, 256 bp, Homo sapiens
gggtcctgttggttttggacagctgcaacctttgagtggtagggaggttctgaccattcatccaccacaggtagcttgcgttcggagttgcaggatcacagattaagatcacagcctccatgatctccctggggtttaatttgctgctggagatggagggcttgggagtctccactgtgcagaaaacagggagaagattgccctgtgtggcacctttgattcctccaaaggcatttttcaatcagagttggcattt

SEQ ID NO: 400059 - DNA, 381 bp, Homo sapiens
gacaaataagagattcactattgcgttgaattggttttccaaaattttactcctgaattagatttacaagacccactattgaataatctacagttgataatctatgttgatggctactatgccataaattctaaaagaaagtactgaattgtatatgctgttacaatctgacacaaattattagaaagaagagtacttcctaaatttagttacgcccaacctgtggaattaattgccctcactcaagactgtgaattaaccaaagataaactgtaaatatatatactcatgtgcttttggagtagtccattatttttgtatgtattatttttgtatggtatggaaatgggatttcttacatctaatggtatgcccataaaa

SEQ ID NO: 400060 - DNA, 499 bp, Homo sapiens
gaccctcagcgctacagcagattgggcgcagagtggctgttcagagctccaggctcaacctcccacagcgatcctgttccccgcagcccgcagagcctcccacacctgaagcgcacgtgggctgcctgctgggtcagcacttgctgcgtatgccgggcagcctgagcaccaaggaggggaacgcagagcctcaggccggcagcgaagcacacagctctccacgatagcctgttctgaatccagtctgcggtcttcctcctagtgctttttcctcctgcttccctgtccctggaataagctacctgcacggaagcaggagacctgtgaaagaaccatctctcggcagctgggtgggaaggggccgcaacagtgtatacaggggctgggcacggtggctcatgcctatgatcccagcactctgggaggccgaggtgggtggatcacttgaggtcaggagttcaagaccagcctgggcaacatagcgaaacccgcctctact

SEQ ID NO: 400061 - DNA, 541 bp, Homo sapiens
gatcagatccttgtgagggtgtcttcaggagaattggggcacaaaaatcgacagaaacccccttctctctgaagaccccaaactatcttgttattttattattaggacattttccagatgagaaaacagaggctttaaggggcaagggccctctcaagatgagccagcagatgggaggggcctgcagggggtctgtgtccacctgactgtgaagcgtggcctgggccctacatgcttcagggacggggttggggaaagtgagagcactctggggatgggacaagcacagtgtcatggggagcagtccttggggacagagaggcccagtcccccagatctggatgtgaaactgctctggggcctgggatgcactctgtacttcaaaatcagttttcgttgtaattatgcagtagtacctgaacacgtgctcaggaaaaacctgcaaacaatacagaagtctatgagtgacaaagggcgtttccccacggtccccagagggagtctctgttttcccttgggagcctttcttcactgcctggtt

SEQ ID NO: 400062 - DNA, 279 bp, Homo sapiens
gaggatgaaaaacgaaaccaggtaaccaggactttctcacacgttccacccaggacacgttgacatgatgatctcctagcatgtgctggggatggatctgggtgccagggacatagcatgaacaaaacagataaaaatctcttcctttaagaagttgggccgggcgtggtggctcaagcctgtaatcccagcactttgggaggccaaggcaggcagatcacctgaggtcaggagtttgagaccagcctggctaacatagtgaaaccccatctctactaa

SEQ ID NO: 400063 - DNA, 380 bp, Homo sapiens
aggctaggacagaaaaggtagagagactttcactcaatgagtcagggaataattcctaccaaaaggcgacagcaaaaaaaaaaaaaaaaaaaaaagacactttaagctcagagagttagggaatagtccctattgggaaaacaaagcaaaagaaaaaaacattttatcctatgaagttagaaaataattccctactcagggatatcagaaagtcaggacttcctgacttaagcccagtcagccagaaaataatttctcctagcagaagagtcaggaagaatagatatccaacctacatgcaaggaaatgggttttctataaagaaagacaaccatgaagaagagagtttcagatgaggagtaaaggtctaatgttcacta

SEQ ID NO: 400064 - DNA, 2039 bp, Homo sapiens
  misc_feature (1039)..(1039): n is a, c, g, or t
tggttatgggctttgtttctggagctcagacagtccttagtttgaatcccaaatctgtccttacctccgataagcctcactaaagctcactaaacctctgtccccttatctgccaattggagataatcatgatatttaatcctatggagtgctgtgaggattaactaaaacaatgcatttgaagttcttggcactatgtctggcatggaggtatatgactatgatttgtaaattgcaatgcttctgagatggcagtagagggagcagagtcaatgggaactggacttcagaaaattagcaagattgatattaaacccttttacaagacaatgttcctgttctgatggagctagagcaacctgcacacagatgagtcgatgagattcacaccaggccatcttatcccaataatccttgctgtcccactcatgtggtactagcagatgcaaccagggaactcaacgcatctttctgcgtgtacatattgtctgtccaacctccaactccagctcaccccagtttcctcagaacacttaagaggggagaggagaagtatggtgatatcacaaaactgaaactagcaaatgtttatattctttgtacaaaaattgggagaaggtggagctggtttacctcccttacagcggcaagagtgatatcctctctcttcctctctctgtttcccacaaaagcagctccactgggcagagtgggaaaagcacaatcagaaccgattttgaatccaccctgtcttctatttacaactgtgaacctgcctatcccacccagactctcttcatctccatttccgctctgtacagcaaggtggcagggaagctggagggttaacctggtgagtgccaaagttacccataacttgtttattattctattattaacagctattgattcagcatttaacctgatcccatttcttacattatatctttgacttttcccagcaatttcaggtgggacataatatccccacttttatagacagggagttttggggttagagaagttaggtaacttatanaactttgtgccactagaaattgacacaccagaactagaagctacttttctgaaagtctttaatctgggattttcttcttagcatgatgcagcaaaaaattagatatagggcttatcaccagggcaactgggtggctgtttgagaaaggagacaggaatctgtgggggcctttgaatttggaaaaccttccaggggtttcattttagcatttggtttgttcttcattttacttcgaatttttttatgtctttgtctctgagggactgacaaggccagggccagtgtagggtcaagaaactgcagacctgcttatttagttttgattctaaaaaagagaaacaaattggacatagaagcgccctttcttagatgtcttcctccactcatgaaatacagaaggaagacagaggttcaaggcagaagatttaaccaagaaaaaagtgcgtatttgggcagagagtccctcatgatagacatctctggataaacgagttacagttggcagcatatggcaaatagagcagaggttctctaagtgttacctgcagatccctgggagtggtccccgagatctttttagagcatctgcaaggttaaactatttttataataatactaatacagttttgtcttttcaccctgctgacatttgcaccaatggtaccaaagcaaaggtgggtgaaactgttggggccttagcacaaagcaaggaagtggtgccaaattatactagcagttgtatatttcaccaccatgcacttacaataaaatgccagtttgacttaagaatgtttttgatgaagcagtaaaaattattaattttattaaatctcagaccttaagtacacgtctttttaatattctttgtgatgaaatggaaaaggcacatattaaaggatgatggtcatctcgaggaaaagcacttgcgtgattgtttgagttgccaagacgagcctgtcactttaaggaaaacaactggtagtatctgctgccaataata

SEQ ID NO: 400065 - DNA, 351 bp, Homo sapiens
tattttgcaataaatattgctattgctcactttgggtttatattgcctttatgagctgtaacactcaccatgaaggtctgcagctttactcttgaagcttagcgagaccactaacccaccagaaggaagaaactccggacacgccgcctttaagaactgtaatactcagtgcgagggttcacggcttcattcttgaggtccctggaactcagcggcaaggtctggacacgtgtcgtcgcgggcacagaaggtgcggcacgaagaccagctcttatccagaggcagaggaagaggaccatcaaattggagcaattttgatgacacattcattaaaatttgttgaattgtaca

SEQ ID NO: 400066 - DNA, 409 bp, Homo sapiens
gagaatgaagtatggatgaaccatgacttttaaagttggtaggcatgggaaatttggagggaaaagagatttctgatgagtctattattaaaaaccaatctataggaaaaaaagataagagcattagaggttagaaacaaggtcaggtccttcactctgcaagcaattctttcacttgattaagctctgtcatctcctttgccccattccccaagttaaatgctctacgacattcttgtcttcttctacccctcatccgatgacactgtctcccatgtttaaaaacaacaacaacaaaaccaggatgccaacaccaccaacttccttaccatctaccttcaaacttattataactttatatacatatacacatatatatttaaaataccttattacttccatatcatct

SEQ ID NO: 400067 - DNA, 5808 bp, Homo sapiens
  misc_feature (4)..(5): n is a, c, g, or t
  misc_feature (8)..(8): n is a, c, g, or t
  misc_feature (10)..(11): n is a, c, g, or t
  misc_feature (13)..(16): n is a, c, g, or t
  misc_feature (18)..(19): n is a, c, g, or t
  misc_feature (21)..(23): n is a, c, g, or t
  misc_feature (82)..(82): n is a, c, g, or t
  misc_feature (503)..(503): n is a, c, g, or t
  misc_feature (1383)..(1383): n is a, c, g, or t
  misc_feature (1970)..(1970): n is a, c, g, or t
  misc_feature (2052)..(2052): n is a, c, g, or t
  misc_feature (2540)..(2540): n is a, c, g, or t
  misc_feature (4692)..(4692): n is a, c, g, or t
  misc_feature (5403)..(5403): n is a, c, g, or t
  misc_feature (5629)..(5629): n is a, c, g, or t
cggnnggntnncnnnngnntnnntctgtaggggagggcctgccctcctggcaggggcccttgtgtgcgtcctgagctcaccntggttttggaggtggctgggcagtggcgggcagagccccatgctgtcctctgcctttgaggtgggcacggcacacgtgagagctgagcattggtggaggaggccacaaccggtgcccagtggttgagtcgctggtgcccaccgagggcccagggagtgagggaccccctgaagaggtagctgggagccagaccctcctcccgtggatgccttttcaagtccctgtcagttgttcagagaagagggggaggattcgcgctttgcgtcagatgcgtgcgtcctgcatgggtggtgccggccggctgtgcccaaagtcatgccctgcccctgtctcccgcagcctggcatgggctcacgtccgtgtgcttgtccagcctccactcgccacagctcccctcccctcccctccttttccctccccncctttccgctcccctcctctcccctcctttccgctcccctcctcttccctcctctgccctctgctcccctctcctcccttcccctcctgtcccttcccctcccttctcctcttttcccctcccttcccctcccttcttttcctttcccctcccctcctttcccctcccctcctctcccctcctctcccctcccttcccctctcctcctttcccctcccctcacctgtttgactctgctgtgccaggggccagggcagggctggcccctcactctgcggagtaaatgggtgtgggggccgggcctgtctgggatcagggcagccaggcagggtctcctgcaggagcaggcatagtcccagggagcaggcagctgcctaggaaggcagtcaagcagatggggacctcggctgccccaagactggcccggggctggtcctccctgcgtctggcctctgggtgggtggtggtggcttccttgtgacttcatccctccgatcgggcaggtggttttgtgcagtgtgtgcctgggaggcgcacggcagcatgatcggtccctgagtgtcacggcagcatcagaggccagtttggcatctggagtagctgccaccgagagaggcccagccgccaggcagctgggagcacaggtgtcggcatcccactgggagcacgggtgaggtgcctcccttctctgggcagagtttccccagttggtggtgtagacgccaggaacgcggttgtacggacttcgtgaggatctaacacagcagtgtgtaaaaacagcgccaagcgtgtcctcggtgggcgctcagaggcggttgtgagcagtgcagatgctgttggcctagttctgacagggtggcccaggggtctccccgtggcntggcatggacggtggcagctcctgtggtcatcactgccatggtccggagcggccctgggctctgcagcaaggcggtgaatgtggagctgagcggtccgaatcagggtctgggttgctcgttcaactcaggaacttccccagattcctgagttttcctctagccgaggtcaggggcagccaagggaagggtcagccagctcatccagacctcgctctgcaacaaatctccagcctgggttgccatgaggcaccctggggaggactcaggacgaggccccttgaggctgaacctgagacctaggaaactccaggtgggtcctaacagggcttgtcactgagcgtaggcctggacacggccctgtggtgtctcacccacgggcaccagtccctgttgagcaaggtccacgcagccctttgttctggacggagctgacgctcaggccacagactccgactccattcttcagaggcttcatcgcctgcacaggaagagaggcctggagataccaggttgtcttggggccacagctggcccttggcatggctggggagcagcaaagcagttcattaggaccagggctgaccanaccagtgtccatgcccagaggttctgggttctgccctcttgctgtcgtccggtgcaggccacatggccacctgggaaggccngggtcgtcgtcatattccgagtgtgaccaagagttcaggggcccaggtacctttctgggcccctctcagggtctttggaaaagtccagaatgagctgggctggtggagaattcaggaggtgtggccagtgcccccctgtgctctcagaagcaggggtcactggcgagagggctgggtggcccggcgatcaacctgaaggcattccttacctgcccttggacccggtgagccagtgactggcgtaggctttcaaacctttcaaaccacttctcctggagccccgtgttgtgtgcgtccctcagcccatgcaccccggaaggcacgcctcgcacccagctgtagagccccatgttgtgtgcacccccagcccatgcaccccggaaggcacgcctcgcaccgtgctcctggtggggcccgtgccaggggggcccaggctcctggggacagtggcccaggacttgggatgttagaaataaattttgggtgcngcaaaagaaatagcactcgaacataaatttaattttctcagcaaggcaattttacttctatagaagggtgcgtcttgcagatggagcaatggcgagagcacacctgaacgagggaggtggaggtctcatcctaacgcagccagtccctgctgctgtgtggttcccctgttggctagggttggaccgcacagtctaagctaattccgattggctattttaaagagagtagcagtacgagccggagtggcggggtgaatagtttgacgggaaggatggttacagaacaggtgactcaggatgactaagaacagagcaggtgacaaggatgactaaggtcagagcaggtgaccaggagtgactaaggtgaccaggggtgactaaggacagagcaggtgatagaggctaggcaggggttgtttactgaaactaggggcaaggatatgtaaagtacaaggaagttaaactttagaatgaagaacaaagaatggggatgtaaccatacggatacattgcttctttggagaggagctcagaattcattatacttaacaatttacaggctaaaacctttgaagaggaatttattatgttctacaggagcggtgccgctggcctgtggcttctgcagggacaagtagtggctgtggccgggaggcgttcggcagctgtgcttcagccccggccccagcttcagctcttcgagttgctggcttctctaaggcctgtcctgaagtggcctggagactgctgagttacttctggaatctgcaccgtgaaagtgaaacctggaccatgatgtgaggctggtgagagggtgccctgccgtcacccccggccttgtagaaaactcattccaatggccctctggttctcactcaggaccaaatagtgatggttttttgtttgttttcgttttgttttgttttgttttgttttgttttgtttttttagacagagtctcgctctgtcgcccaggctggagtgcagtggcgtgatctcggctcactgcgagctccacctctcgggttcacaccattctcctgcctcagcctcccaagtagctgggactacaggcgcccaccaccacagttggctaattttttgtatatttagtggagatggggtttcaccatgttagccaggatggtcttgatttcctgacctcgtgatccacccacctcagcctcccaaagtgctgggatgacaggcgtgagccaccgcgccgggcccaatagtgatgtttttactgctctgggcctgatcgcatgcaccgttgtctgtgctgtgacttccgtcgttgtctgtgctgtgacttccgttgttgtctgtgctgtgacttccgttgttgtctgtgttgcgacttctgtgggatattcgttggagaaggagccacacagctgtgtgggacccggcactccttcatcaccatcatccagggccacggacaccccctctcacaagtcgctgggatatgaaattagggaataaatgggaattttcagtgcgatgcagctggcgctaggatcctcctcagtgtgacgtctgagaccttttcccagctggagccctgtcattcattcattcattcatcccatgccaggctgggcggctgccagaggcacaatccggaaccgccccttgctaatgggcggaccagtgaaagcaaagcgggctcactgtgcagaccaatgattgacagttccagggtgtgatggacacaggcggctgccaggaaggagccccttcagaagcagtgggcggggcggggtggggaaggccgtggggaggagtgacttccagatgaggctcacaggactgtacccggagggagggggcagcaaggaccctgtgggcagccgggggcacggcacaggctgtggctgtaggtgtgggtggtgcccaggcattgacagaggggagctcactggacggggcagcgtggaggtgagggtcgggtgagggcccctcgggagcccctggccatgttagttgcacatttcatgactctttaaggagttagtgaggcctgggtgtgacctatttcccgttccaattaaacaggtcattagtccgtgtcgtgctaaagcagatcactcgcaaggaatggaaaacccttgaaatacgttttttaaatcggtgaaagtgagaaacngatgcctctgtgggaaaagaccagactccagggtctgcaccctcagagtgatgagctgcgtctgttaggggtgacctgaggtccctgctttgaaccagcttgttgaaaccggaagccatttctcatcttctgtaagagcctgcagcccctgtcagatgccagccattccccaggtcttgctgacactgtcattaggattcctatgagggccagtggggagacagctcagtctcggccctgcttccgaccccaccaccacccccaaatgcatactgctggcctttcctgggtttaattttattttgcagtggtagaggttgttttgctaaaattatttcaaaatctgccttgtggaaaaacgcccacgtcagggtgaccatctgtggtaaccgagaattccttggaggcagcgtcttcaccgcctggctaagcggatggcacaagctgccagccagacctctgtctgtccctgcccagaggccccagctgccccttcctccaggcacctccctgatctctggagtccaggttttgttcccaaggtcctacctttgtatctaaatgctgtgtcctctccccggacgatctcctccaggcactggctctcaggggccagctccccatgggcgatgatgtctctgatacaggaacttatgggtaccttgcaagtttgcacagaaagtggagcccgtctgttccttctggggtgtncgagcggggcctcggggagcaggtgcaggacagggcacaggaggaacaggcacggctggtggtgtgcagtgaacagcagtggtcacaccaggtggtggctcccgtgggacttttgaggccggcccagccctgagcaggtggggtctgcagaggcctcgtgggttggaggagacttattcagagggagttttggtcttgctagaaattgcatgagatgaaagatganattttaattctatcattgaggcatagtctttccaacacaccccctgaggtgtgagggaggctgtccctatatgatgtggtccccgctccttcaggctggggctcctggccagttcatctttcgtcctgtgtctgactttctctatcatttctaaaatgactaagacaatttattttgtt

SEQ ID NO: 400068 - DNA, 429 bp, Homo sapiens
ctccatccatccatccatccatccatccatccatccatccatccaggatccttctcttcatccatccatctacacagccttcatctggtcagagatacagacaccaatgccaaacagcagggcccagagttgtcaggacgctacagtgagtgggcagcagaggtccctgggggtggccagggatcacggccagtggtgtgcactcctgcttctctctctaaggctggccgagggcagggaaagtaatttgtgggaaagtaaaggattgaagtcaaatcacaactctacttttataatctggtaactggacccaggtgacttaacctctctgtgcctcagttcctttgcctgtaaaatgggcataagagatgtttctttggggttcttatgaagattaaatgaaaatgacaatgtaaaccaagcaagaga

SEQ ID NO: 400069 - DNA, 746 bp, Homo sapiens
aggatcaccatttatttcctatttagatatactgacattcatccatatgaaaatatgcaggtcattagcttactataattttactatttacttttgacttaatggggcataaataaaactttcttagtacacatgaggtggatatttgatacacagaacatttgtggtgggctttctgtgggttagatgtaaagcccacgtattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatttagtccttcctttcagttgtctgttaggtccattctgtttactagacggatgttaataaaaactatgtgagcctgaacgtattctcggccaaatttagtcttgtctctcatcttgattggattaattctaaagtctaaaatgattcagtccacaatagctctaggggatgaagaatttgccttactttgttgttcgctcagttcctaagactgtgagttgtcaaatccctagactgtaagctcttcaaggagcaagaagcacattttctccgtgtcatgtaatttttctaaggtgcttggcagcactctgtaccctgtggagtactcagtaccttttgtttgatgttgctgacaagacctaaaaaacaatccctta

SEQ ID NO: 400070 - DNA, 268 bp, Homo sapiens
caaagcttagggattttttacataacttttcagcatagaaaaagaggtacttagaagtattgaaggaaaaaatgaagacctaagaaaaaaatatttcatgatcatttccctaagccatttccagaatggtaaaaggtttaatcagtttttattacctcatttttaagcctgtatgagaatgtagaaactatatattatatgtatatttattttatgtatattttatgtttgtaaattgtttagaaagataattggttatgagatgtaa

SEQ ID NO: 400071 - DNA, 287 bp, Homo sapiens
cagcacagggattctgtagcacagggaaactgttctgtatgatgctgtaatggtggacacgtgacactctgaatatgtcaaaacccatagaactttacagcagacagagggaacttaaaataggcatctgtcagactaagagcaaaaggaagaacacataagcgccgcactctaattgataagatcaccccccaccagggtagaggtgaatgattctgcaacctctccacctttataccggaattcaagaactacggcaatggatggaagacggtgggagccaggtt

SEQ ID NO: 400072 - DNA, 426 bp, Homo sapiens
agaaattgagatttatggaaaagatgcccttagtgtttctacagtaagggcagaaagatgtgatacctttcctcacccatcttaaggttcaatggctgacacttctgcaacaaaagacaaattaacaagaagaaagcataagaggctgggtgtgactcacacttgtaatcccagctctttgggaggctgtgctgggaggattgcttaagcccaggagtttgagaccagcctgggaaaaacggtgagaacctgtctgcaaaaaatttttaaaaattagcctggcgtggtggagcatacctatagtcccagctacttgggaggctaaggtgggtggatcgcttgagctcagaaggttgagattgtagtgagctctgtttgcaccactgcactttggcctgggtgaaaaagtgagacttgtctcaaaaa

SEQ ID NO: 400073 - DNA, 465 bp, Homo sapiens
tgtaaataaagttttattggacctatagtgacagtcatttggtcatttgtttatgtattgtttgtgtctgtgttcacgttttaatggcagagctgaattggtgccagagactgtatggcccacaaagcctaaaatatttactaactggccttttaaaggaaaagtttgccaaccctactctaaggggtccagcgataggaggcgcataaaagcagctgtcacctctaggctgaggaaaaaaggacagtaaaacactctgaggactgtgataaagtctctccccgaaccttagactgaaatttagtctctttgaagagagtatggctctcacaggaatacatagttgcctatggcaaagaaacctgctagataaatttagccaaaggtgtcaggtaggagaacatagcatgagggtgcagctagaggtagtctttgaggactactcagctctcacactgaattaaa

SEQ ID NO: 400074 - DNA, 469 bp, Homo sapiens
ccctgcctagaaaagacattttaataaccttggctgctaaggacaacattgatagaagccgtctctggctatagataagtagatctaatactagtttggatatctttagggtttagaatctaacctcaagaataagaaatacaagtacgaattggtgatgaagatgtattcgtattgtttgggattgggaggctttgcttattttttaaaaactattgaggtaaagggttaagctgtaacatacttaattgatttcttaccgtttttggctctgttttgctatatcccctaatttgttggttgtgctaatctttgtagaaagaggtcttgtatttgctgcatcgtaatgacatgagtactactttagttggtttaagttcaaatgaatgaaacaaatatttttcctttagttgattttaccctgatttcaccgagtgtttcgatgagtaaatatacagcttaaacataa

SEQ ID NO: 400075 - DNA, 634 bp, Homo sapiens
cagagacagagtcttgctctgtcgcccaggttggagtgcagtggtgggatctcagctcactgtaacctccacctctcagattcaagctattctcgtggctcagcctcctgagtagctgggactacaggtgcgcaccaccatgcctggctaattttttgtatttttagtagagatggggttttaccacactggccaggctagtctcaaactcctgacctcaagtgatccagccgccctggcctccgaaagtgctgggattacaggcatgagccactgtgaccagcctccgtgtaaatctatacaatctattcctcagctcctttccagaatatcctggaagacatgtaaaacatgtatgtgagtgtgcacatatggattaaataataaatcacttccaggaaggaaaggaagtttggttatctttaaacaatttctgtggggtttttttttggtactttgattatgctttcaaaaacaatattccagatttctttcctcttttccatcctcagattcctttgcctaacatcttccctaaggactaacctctccccatccaaatgagattacaataccctcctctcctacttaactttctttttcttttttgagacagaacctcactccgttgccc

SEQ ID NO: 400076 - DNA, 581 bp, Homo sapiens
cagagacagagtcttgctctgtcgcccaggttggagtgcagtggtgggatctcagctcactgtaacctccacctctcagattcaagctattctcgtggctcagcctcctgagtagctgggactacaggtgcgcaccaccatgcctggctaattttttgtatttttagtagagatggggttttaccacactggccaggctagtctcaaactcctgacctcaagtgatccagccgccctggcctccgaaagtgctgggattacaggcatgagccactgtgaccagcctccgtgtaaatctatacaatctattcctcagctcctttccagaatatcctggaagacatgtaaaacatgtatgtgagtgtgcacatatggattaaataataaatcattttttggtactttgattatgctttcaaaaacaatattccagatttctttcctcttttccatcctcagattcctttgcctaacatcttccctaaggactaacctctccccatccaaatgagattacaataccctcctctcctacttaactttctttttcttttttgagacagaacctcactccgttgccc

SEQ ID NO: 400077 - DNA, 646 bp, Homo sapiens
atggcagcagttggacctcacagtgtggattgtgccttcaccctggaatgtttatgccctatcaccatggtgatgggattagggatctcctgcccttggtcctaagtgccactatctgtgctgagtttttcaaaggtcagagcagattgaaccattgtggtttcattttccctgattttgatttttcttatggggaacctgtgtggctgcattcaaggtgactcgaagaagccttccaaaaagcatgtgaaaaggaagccctactctactaccaaggtgacttcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgcgagggtggtgcaggtggcccctctgaggcttgaatctactccccatgaggacaccgtacacgacatcactaacgaggacgccacacacgacatcgctaacgaggatactgtacacgacatcgctaacgaggccg

SEQ ID NO: 400078 - DNA, 329 bp, Homo sapiens
ctaagttccagtccctgagtcattcatgagtagcactgccaatgaactgacagccatgctgtgtccctccacatcccctaggtgactcgaagaagccttccaaaaagcatgtgaaaaggaagccctactctactaccaaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatact

SEQ ID NO: 400079 - DNA, 487 bp, Homo sapiens
agttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcaccagataatgcatacctgaacctggaaactgattcccactgcagaaagtgttctgagccacatcccttagcttcactagtgcaggtccacctgggaggatgtcccagcatcagcttgacccatgctgtgatcagccacctccatgcatcacaccaagcaagcccctgggtgattcacagtctccaccaccagggcactgaccttaactctgtgtttttctagctccccatgaggacaccgtacacgacatcactaacgaggacgccacacacgacatcgctaacgaggatactgtacacgacatcgctaacgaggccg

SEQ ID NO: 400080 - DNA, 398 bp, Homo sapiens
agtcagttactgaccctcagattgtgccagggttgtgtgtttatgtgtgaacaagagagtgtgagtgtgattttgtccacttttgatatggaaggtgagtccgacctcacatcgagagaagccacaacagtgaccaacccttacagagggagatttgatgacagacacccattaataaaaatatggcaaatgtccactgcagctcagaagagagtcttcaaggaggtcagagaatccacagctctgctttgtgcagggatgtctcctcttcaccaaagcatttagcatccactggggtaaacagggaggatccagctgtgtctgctcattccaagtggttttgagaaaacaaaatcaacattaaattaaagcaaataatcagagatgtattaacacta

SEQ ID NO: 400081 - DNA, 609 bp, Homo sapiens
cccttctttattaaaaaaaaaaaaaaaaaaattaaaagtgcggttgtggtgatgtacaccagtagtcccaggtgcttgggatgccaaggcagaaagattgcttcagtccaaagtttgaggctgcagtgagctatgatggtgatggtgccactaagctccagcctgggtgacagtgcaaaactgtctcaaaaaaaaagaaagaaaaagaaacagaattgtccaggacatttttcccccttctgggtatctccaattcttctatccctggttcacctcagagtattgcagttctgagaaccagtgcattctggattcattgtagaactttgattctctacttgactgtatgtcagaatcaccagagagcttgaaaaatcctgatacctggatcttttcccgcaaaactctggttcatttggcttgggattcagtgtgggcattaaggagtttcatcagctctccatgtagctttaaatgtgattttaagctggttaaaaaccacagctttaaaatgatatggcctagacagtgcactgttaggtaaatacttattccataggcgtcagggttaagttgatatgcagagaagatctctaaaggaaaaaaaaa

SEQ ID NO: 400082 - DNA, 549 bp, Homo sapiens
tagaacatttttctcctttctgggtatccctaattcttctatccctgattcacctttcaaaattcatctcagagtattgcagttctgagaacctctgcactcctgggtgacagtgcaaaactgtctcaaaaaaaaagaaagaaaaagaaacagaattgtccaggacatttttcccccttctgggtatctccaattcttctatccctggttcacctcagagtattgcagttctgagaaccagtgcattctggattcattgtagaactttgattctctacttgactgtatgtcagaatcaccagagagcttgaaaaatcctgatacctggatcttttcccgcaaaactctggttcatttggcttgggattcagtgtgggcattaaggagtttcatcagctctccatgtagctttaaatgtgattttaagctggttaaaaaccacagctttaaaatgatatggcctagacagtgcactgttaggtaaatacttattccataggcgtcagggttaagttgatatgcagagaagatctctaaaggaaaaaaaaa

SEQ ID NO: 400083 - DNA, 302 bp, Homo sapiens
ctttgctagtgaacagctaagctgctttaggcatgtaatagaacattccatttcctgttcccttgctgacacagaggagtgttcctgctggcaatgatctaatcatagtgcagtaagaaacatggcagtttgataaaacatggtgagacagcggctgaaatggaagcatatgttctagaagacattcttgaggtagggctaggtttgtaagtgaaatgaaagttgaaatctgaacaaagaaatcttatctgccggaattattttacagatgaatagattagaggagagagcaaagagaagca

SEQ ID NO: 400084 - DNA, 701 bp, Homo sapiens
ccggtcgacttttgggggtccccccaagctttatagggcccaaaaaaaaaaaaaaaaaaaaagacaatgctatctgtgtcattggtttttaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggtaatatgttgttcactatatgagcaagggactctattcggttaatatatcttccattctaagaattcctagtttgagtagtaaagtgtaatatgtagccattttcatttatctagtatttgggaatgaagtatgcgatttaagagattcttgcagattatttacttacctaatgaatcaataaaacatcctctgctataggattaccttatctttaaaaataatacttgaggccaggtgcagtggctcacccttgtaatcccagcagtttgggaggccgaggcaggtggattgcatgagcccaggagttcaagaccagcttgggcaacatggggagaccccatctctac

SEQ ID NO: 400085 - DNA, 400 bp, Homo sapiens
ctttgctagtgaacagctaagctgctttaggcatgtaatagaacattccatttcctgttcccttgctgacacagaggagtgttcctgctggcaatgatctaatcatagtgcagtaagaaacatggcagtttgataaaacatggtgagacagcggctgaaatggaagcatatgttctagaagacattcttgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggtttttggatcagtacatctgtagggccttagattcttcatttctgacaagctt

SEQ ID NO: 400086 - DNA, 4385 bp, Homo sapiens
ctttgctagtgaacagctaagctgctttaggcatgtaatagaacattccatttcctgttcccttgctgacacagaggagtgttcctgctggcaatgatctaatcatagtgcagtaagaaacatggcagtttgataaaacatggtgagacagcggctgaaatggaagcatatgttctagaagacattcttgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaatccaagtcctatcatctctccttcagccatgcttcctatctaccctgccattgatattgatgcacagactgagagtaatcatgacacggcgctaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagacggtgcctggcgagtccaagagca

SEQ ID NO: 400087 - DNA, 4244 bp, Homo sapiens
agtatcgcgagacgaggtgagagctggcggagcggcggcggcggcggcggcagtagaggtgaccgaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcgctaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagacggtgcctggcgagtccaagagca

SEQ ID NO: 400088 - DNA, 4876 bp, Homo sapiens
agtatcgcgagacgaggtgagagctggcggagcggcggcggcggcggcggcagtagaggtgaccgaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcgctaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagacggtgcctggcgagtccaagagca

SEQ ID NO: 400089 - DNA, 923 bp, Homo sapiens
cagtcgactctgagatcccccaggttgcagatatcctatgtagtagtggttgtggcacttggaggttctgtcaagacttcaggctcatcttcaactttaagcttttctttttcttgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagacggtgcctggcgagtccaagagca

SEQ ID NO: 400090 - DNA, 379 bp, Homo sapiens
ataggaagactccatctccacaagaaatttaaaaattagctgagcgtggtggcatgggactgtagtcccagctactctggaggctgaggtaggagaatcatatgacccctggaggtggaggctgcagtgagccatgatctcaccactgcactccagcctgtgtgacagagcaagaccctgtatcaaaaaaaaaaaaaaaaaaaaaaaagacaatgctatctgtgtcattggtttttaggggagctcatattgatgtacgtaacaagaaggggaacactccattgtggctagcagcaaatggtggacacctcgatgtggttcagttactggtgcaagcaggtgcagatgtggatgcagcagataaccgcaagataactcc

SEQ ID NO: 400091 - DNA, 304 bp, Homo sapiens
gttagttcaggcatagatttactgaactgttagagtctgttttcaatctgacattgatatctattttttagggtcatgtgaaggtggtgcgctacttagtcaaagaagtcaatcagtttccatcagattctgaatgtatgagatacatagcaaccatcactgataaggtaatatgttgttcactatatgagcaagggactctattcggttaatatatcttccattctaagaattcctagtttgagtagtaaagtgtaatatgtagccattttcatttatctagtatttgggaatgaagtatgcg

SEQ ID NO: 400092 - DNA, 4997 bp, Homo sapiens
agtatcgcgagacgaggtgagagctggcggagcggcggcggcggcggcggcagtagaggtgaccgaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcgctaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagacggtgcctggcgagtccaagagca

SEQ ID NO: 400093 - DNA, 4767 bp, Homo sapiens
agtatcgcgagacgaggtgagagctggcggagcggcggcggcggcggcggcagtagaggtgaccgaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaatccaagtcctatcatctctccttcagccatgcttcctatctaccctgccattgatattgatgcacagactgagagtaatcatgacacggcgctaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagacggtgcctggcgagtccaagagca

SEQ ID NO: 400094 - DNA, 4815 bp, Homo sapiens
agtatcgcgagacgaggtgagagctggcggagcggcggcggcggcggcggcagtagaggtgaccgaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactgatgtagcagatgtcttacttcaggcaggcgcagatctggaacatgaatctgaaggtggaagaactcctttaatgaaagctgcaagagctggtcatgtttgtactgttcagttcttaattagtaaaggagcgaatgtgaatagaaccacagctaataatgaccatactgtactgtccctggcttgtgcagggggtcatctggcagtggtggaactacttttggctcatggggcagatcctactcaccgtttgaaagatggctcaactatgttgatagaagcagcaaaaggtggccatacaagtgttgtttgctatctcttggattatcctaataacttgctttcagcccctccaccagatgtcactcagttaactcccccatcccacgatttaaatagggctcctcgtgtaccagttcaagcactgcccatggttgttccacctcaggagcctgacaaaccacctgccaatgttgccaccactcttcccatcaggaataaagctgcttctaaacaaaagtccagcagccatttgccagcaaacagccaggatgtacagggttacatcaccaatcagtctccagagagcattgtagaagaggctcagggaaagttaacagaactggaacagaggataaaagaagccatagaaaagaatgcacagctgcagtccttggaactggctcatgctgaccaacttaccaaggagaagatcgaggagctcaacaaaacaagggaggaacaaattcagaagaaacaaaagattttggaggaactacagaaagtagaacgagagttacaactgaaaactcagcagcagctaaaaaagcagtatctagaggttaaagctcaaagaattcaacttcagcaacagcagcaacagtcttgccaacacctgggattactaactcctgttggagttggagagcagctttctgagggagactatgcacggttacagcaagtggatcctgttttacttaaagatgaaccccagcagactgctgctcagatgggttttgcgccaatccagcctctggcgatgcctcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcagcagtcagtggaagagcatctgcaatgtcaaacactcctacccacagtattgctgcatccatttcccaacctcagactccaactccaagtcctatcatctctccttcagccatgcttcctatctaccctgccattgatattgatgcacagactgagagtaatcatgacacggcgctaacacttgcctgtgctggtggccacgaggaactggtacaaacactgctagagagaggagctagtatagagcaccgagacaagaaaggttttactccactcatcttggctgccacagctggtcatgttggtgttgtggaaatattgctggacaatggtgcagacattgaagcccagtctgaaagaaccaaggacacaccactctccttggcttgttctgggggaagacaggaggtggtggagctattgttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggtaatatgttgttcactatatgagcaagggactctattcggttaatatatcttccattctaagaattcctagtttgagtagtaaagtgtaatatgtagccattttcatttatctagtatttgggaatgaagtatgcgatttaagagattcttgcagattatttacttacctaatgaatcaataaaacatcctctgctataggattaccttatctttaaaaataatacttgaggccaggtgcagtggctcacccttgtaatcccagcagtttgggaggccgaggcaggtggattgcatgagcccaggagttcaagaccagcttgggcaacatggggagaccccatctctac

SEQ ID NO: 400095 - DNA, 501 bp, Homo sapiens
acaaatggcataaaaatagctgtgcctttaatttgtgataaaggctatttgctttttcccatagaaagctgacatatacctatcaaaatggtggggtttgatgcagccagtctgttgcattaataagagcaatgacactgaaacttagaataatgacaaaacatacatgatttaggtttagagaaaaaactatttttgaaaaggttttctaaagactatttaaaaatatagggaaggattgggtgtggccttcctgaaactgctctcaaagtgttgtaacccttggagaggtataaagaatcaagaggaaaccatttgagacataggtatttagcatttatcattttatatttaagaaacaccatagcgtgcttggtgctcaacattaaacatggttttttggagttcttctccaccatctagctatagaaatttgtcatataaatgaatctttaaagcagttggctttatatatcctttgttaaccaaccaaaacaaaaa

SEQ ID NO: 400096 - DNA, 257 bp, Homo sapiens
tttgttttgtttttataaaagcaacttcaacattttaagtacaaatacagttgggattttaacttagaaaaaattattctttatgaagatactgttaaagtgtttgctattctgaagctgcctcaaagtaaactagaaatattcaaaagggctttatttgattttttaaaatgcaatatagcattagtggtttttttgggaggaggacttttcttattggttgtactagaagtatttgaataaaaacttttctctca

SEQ ID NO: 400097 - DNA, 300 bp, Homo sapiens
tttaaagaaaatattcactgctattctattgccaaggtcaggctcagaataggcacttaataaataatgtggaataaataaacaaatgtcccatgctcagagtacaaatgctgatataaatcagattactgtctaaaacttgaatttattcattattagagaaactctctgaagaatttgtgggccgggcatggtggcatgtacctgcagttccagctactcaggaggatgaggcgggaagatggcttgaggccaggagtttgagactagcctagacaacatagtaagaacctatccctt

SEQ ID NO: 400098 - DNA, 188 bp, Homo sapiens
cataagtgagagccagctggaacaaaaaacagaagaggcacacccctgcagtggcttcaggtattggaataatcaggcatagaagttatgtttttttatgtttaaagaaacatagaacataaaccgaacccatccctacccataggggactataaggaaatttaccttgacactgagcaaagtagaaa

SEQ ID NO: 400099 - DNA, 388 bp, Homo sapiens
aaaaaaagcacaaacagccccagagtgatgatgcccaaaacttaaatgaccacagcaaccagtgccatgccagtgagttttggagctgagctttggtcttgtccatagaagcttttaagttgaaagcttataaatagagggtttctatattctgtgaatgatagaggtacacagttccaattgtattctgtattacgtgtatgtgccctctttgcataaatgtgcctgacactgtagtggaggccagcttcttgaaagcaaaaaaacacgcatcccattcatctctgtatttccagggctcagcactagtgggtgctcaataaatatactgaatgaatgaataaaagtattactgcaaagatcagtaagtcccatgccaaaaaaagaa

SEQ ID NO: 400100 - DNA, 546 bp, Homo sapiens
ccaccattccctctccagaaagcacccagatgcctttgggagaaccagcctcctccatggaggaaagcttgggatctgccttcccacctggggaggagagggatctgtggaaaatccttctgacggacttcccctcagtgcctgatccatactcaatagtagaaaaattaagaaatatacaaagatagcagatacacggagacagttccccaaatagctgagcgaatagcgcagaagcaatattgaagacctaatagctgagacatttccagaactgataaagtgcgtccagccacagatcaagcagcccagaaaattccaggcagcatcaacaaataaatagccccacatgcacccgtgaaaatgcagaagaccaaagaaaaaagtcctgtcagcagccagagaaaaagatcagccaccaggggtcggtagtgagaaggacaactgtggaagccaggagagatgacagccctgagttccacaggcaatggaagaaagactgtcagacagaaaggttgtccccaatatacttgcactaaaagaaaa

SEQ ID NO: 400101 - DNA, 418 bp, Homo sapiens
ggactcaaagggcaaagaagtagaaagcttcaagaatgctttcttagttatttagaacatgataggaagtatcagtagggagaaatggcagaaaatttaatgtatatatgtcagtgttaaaacacccgcaaggagaatattaagataaaaaataatagtacatatgaaaagaaacaatcaaatgaataactgaacttgtagtgttccacattaaattaaggatacatccttataagcattttactaaaaatcatggatctcacaaacacctggtgagagtaccctggtctcctgattctcaaagtacccccttccctacaactctaacatgctttgtctcaaaaataaattctttctgtacaggaagctagattaggatctacttgaaatttaaggtaataaattctcatttgactta

SEQ ID NO: 400102 - DNA, 370 bp, Homo sapiens
cctttctgtcttaaaaattcctttacaataatagtttaccttcatgccaaattgttaaattgcatttacgtgaaacaataataaagcataaccaaaatagcaacctatgattgaattacatgaatggtcacccctatagtcccatttccatgcctgacatagtgcttactgtgtatcacaggtgtacagtaaatgtttgttgatctgaaaaaactgcaaagtaattaaataaaacaaattgaagtattatgccctcaaactttatactacccttcaaacttacacaatttctttggtttattaacatggtagtttcaaatacaagaaggggcttgtgtttgtctacgtagtaattaactacatagccttt

SEQ ID NO: 400103 - DNA, 386 bp, Homo sapiens
acaaagggaacaattcttagacaatggcccaagagtttgctataaatatggagatggagtcatttgttggctagggcattgctgtggtctgaatgtttctgtctccctgaaactcaaatgctgaaattttaactcccagtgtattaggatgtggggctcttgtgaagcgatcaggccacgagggcagagttatcatgaatgtgattagtgtccttataagagagacctgagagagacacctcgctcctttgaccaagtgaggatacagcaagacagcatcatctatgagtcagaaagcaggccctcaccagacacagaatctgccttgaccttggacttgccagcctccagaaccatgataaataaatttccgtggtttattttta

SEQ ID NO: 400104 - DNA, 600 bp, Homo sapiens
ggaggataaagttggatctttttctcacaccatacacataaattaaaattgatcacagattaaatataagagatgacactataaaactattaggagaaccttcaagatcttaggttgggcaatattgtcttatatataaaacatgaaaatacaagtgacaaaagaaaatagataagtgggatttcaaaattaaaaacttttgtgcttcaaagagcaccgctgaagaagtaaaaggacaatccacaagatgatagcaaatatttgcaaatcatatagctgataaagaacttgtatctgtattacattaaaaactattataatacacaataaaatgacaactcaaatttaaaaatgtgtaagggatctgaacagacatttctccaaagagaaatatacaaatgaggatatacaaatgaccaaaaagcacttgaaaagattctgaacatggttagccattatggaaatgcaaataaaaaccacagtgaaatatgacttcatattcactaaaatgcttataaaaaaaagagacactgacaaatgttggcaaggatatggtgaaactggaatcctcatatactattgggaacataagattttgta

SEQ ID NO: 400105 - DNA, 361 bp, Homo sapiens
tagagttcaaagtgatttaattttcaatggtaataaataccttaatattatctaccaaaaatattgaataatatccaaataatcaagtcaatttttttatttttagaattaagatttctaatagtacctaaagggatttaaaatgtttaattggagaagagaggggcaggatatatagaaaaagatatttaacctaattattttgggtactttatcttttacttaacaaacatttttgagagactactttggcaggtactattggatattggaggttctgaaaatatagcagtaaagaaaatagacaaaactatcttacctcctggagattacactttagtaggccagattaaagataaat

SEQ ID NO: 400106 - DNA, 348 bp, Homo sapiens
gggctttgccaggtgaattcaacaaaggaaggaaagagcaaaggtattgagtatgtatgcaaacctatatggtatagcctattgctcctaggctacagacctgtacagcatgtaactgctgaatacaggcaattataacacagtgttaaatatttgtgtgtctaagcacagaagaggtacagaagggtgggcatggtacctcatgcctgtaatcccagcatcttgggagaccaggaatttgacctggtaaaataacaagacctcatctctacaaaaatttcaaaattagccagataaaaggtattttccatttaacttttttttttttttttgagacggagtcttgct

SEQ ID NO: 400107 - DNA, 324 bp, Homo sapiens
tgacataaaagcaaaccctcagaggaagaatggacaggatttggtcatcaattccgtgcgagggcaacagagaagggtttaaaaatggtttctaggtttctggcatgggtgatgtgtggtttgaagaaggagcaggtgtgccaggagctgagaggtggccgtgggatgtgcaggaatggaggcgtggggtgacacagctggagatgtgcaggaggcacctgtatgtatgggtctgtttcttagacccaggctggagaaaagttgagaattagtcactggtatccacacagtggagaaagatcttctagggagactgtggaataa

SEQ ID NO: 400108 - DNA, 280 bp, Homo sapiens
cagtcgcgcccgctcctcctcgtcggccctggctcagccccgtcaggcaccaacttccctccccggccaagtgggagtgtccggcccacaaagtttccgctgcgaggtcgggcctcggtctctgcaccgaccgcctgtgctgcccgggaggagtggccccctccctccagcagccgcaaggtggaacggctgcccggcaccccattttgctccgcctgtggcaccaacccagacacgtgagcgcccgagcctctcgcacccccaggctgatccggcaggc

SEQ ID NO: 400109 - DNA, 478 bp, Homo sapiens
cagatgccacccgttttctcagacccgtcggtctcccagaccacattgctttgtgagcagatgcctgtcagggacagctctatcagaacagaccgagtccagcccagtgagccgtgatgttctctcactgctcggtcccccctctgccatctacagcgacataggttgggtctgttcccctggcagacagcaggccttcagagccctgccagaatctcttgtgtctcccctagcacacacacatccctccccacccaccaccgccaggcctggatagccctagttctctcccatttcttggtgtcagggtgttcagaccttttaagcagatgaatgctaactcattcaaggcttttaaaacccagtgccttagcagggtacagtggcacacacctgtagttacagctgtgtgggaggattgcaggagttcctgtctagcctgggcaacatagcaagacctccttgtcttttaaaagaa

SEQ ID NO: 400110 - DNA, 500 bp, Homo sapiens
atgtcataaaagtaagaccaaacattgtatctatacatgtaaacacataactttatacacataacctgaaggttggtaaaagtaaaagatttcagattgaatcaaaaagtgaaacccaactccaagttgtacgtaagaagcccacctaaaacagagatttacaaaagttgaaaataaaagaatgaaaagatatactaggcaaaagtaaaaaataaagtgggacaaaaagcattaaaggaaagcagcagcccactttttcctgccatgatgcacatcagagtaggggcaactggaaaagcagggcatccctggaggggcaggtggagcagcggcgagggcctcggtcatcattcccacaggagacctctacttcgtgggttctgtcacagggatttgttactgtggcttcccagaatacaaattctacaattttgtattttagtgcaatttatttgctatttaataatgagttttcaaatacaaaatgctatttaataatg

SEQ ID NO: 400111 - DNA, 394 bp, Homo sapiens
cgtgccactgcactctagcctgggcaacagaacgagaccctgtctcgaaataaacaaaataaaaataaaacccacaaatggccactaaatgtgtgaaaagatgtttccatttactcaaaagtaacaaggggacatcaaaatggcctccagcgtgagggcaggggtttccagcattttagagttgagaaattctctgatgtcaaacttcctggaatccttcatagtgctgatgactatgtttatttttctttccttgaaaaaaaaaaaagggcaaataacttcattccttccccacccaaagactgtaacttttttttattacaataattgatttcttaacatatagtagagagagttgagaaagtttaaagagctttacaatctttccagagtg

SEQ ID NO: 400112 - DNA, 846 bp, Homo sapiens
gttgcctttagggcagtggacagggagaatgactaggaagggacgtgacggaactttcagggtgatgataagtgttctgtatcttgaatagggctttggatcataagtgaatgcatttgtcaaaactcattaagtggtatattggagatttgtgtatttcactgaatatgcattttttctcaattttagttaatacgcatgctgaattgttctctgatgtttgcaacttgaatctttaaaatgagataaatacagtaaaatgttaattgtagaatcttgatgggtttatgggtgttcacttttaggtttcactcaacttttctgtgcatgggtaaacattcctaattgagtgttggagaatatgaatacattcgtgtgtttctctctacctccttcaccagtctcagagtgtttcctacagatgactatcaggtttcctgtcagtccttttttcagcaccatttttatatatgtatataaacatgtttctgtatatatgtggagtatatagaaataagtaggttcttgtctacctttacctgagtaataggaaactcatatgttctggaacttgattttttttcacttaatatgttttggctgtatatataggtttgtctctttcctttataaattatccagtctctgataagtctttattagcagcatgagaagagactaatacactcacagttccacatggctggggaggcttcaggaaacttacaatcatggcagaaggcaaagggaaagcaaggcacttcttattcttacatggtggcaggagagagagagagccaagggggaagtgccacacaccttcaaacaaccagactcatgagaact

SEQ ID NO: 400113 - DNA, 792 bp, Homo sapiens
gttgcctttagggcagtggacagggagaatgactaggaagggacgtgacggaactttcagggtgatgataagtgttctgtatcttgaatagggctttggatcataagtgaatgcatttgtcaaaactcattaagtggtatattggagatttgtgtatttcactgaatatgcattttttctcaattttagttaatacgcatgctgaattgttctctgatgtttgcaacttgaatctttaaaatgagataaatacagtaatcaacttttctgtgcatgggtaaacattcctaattgagtgttggagaatatgaatacattcgtgtgtttctctctacctccttcaccagtctcagagtgtttcctacagatgactatcaggtttcctgtcagtccttttttcagcaccatttttatatatgtatataaacatgtttctgtatatatgtggagtatatagaaataagtaggttcttgtctacctttacctgagtaataggaaactcatatgttctggaacttgattttttttcacttaatatgttttggctgtatatataggtttgtctctttcctttataaattatccagtctctgataagtctttattagcagcatgagaagagactaatacactcacagttccacatggctggggaggcttcaggaaacttacaatcatggcagaaggcaaagggaaagcaaggcacttcttattcttacatggtggcaggagagagagagagccaagggggaagtgccacacaccttcaaacaaccagactcatgagaact

SEQ ID NO: 400114 - DNA, 6350 bp, Homo sapiens
  misc_feature (19)..(19): n is a, c, g, or t
  misc_feature (640)..(641): n is a, c, g, or t
  misc_feature (749)..(749): n is a, c, g, or t
  misc_feature (2460)..(2460): n is a, c, g, or t
  misc_feature (3019)..(3019): n is a, c, g, or t
  misc_feature (3034)..(3034): n is a, c, g, or t
  misc_feature (3212)..(3212): n is a, c, g, or t
  misc_feature (3554)..(3554): n is a, c, g, or t
  misc_feature (3897)..(3897): n is a, c, g, or t
  misc_feature (3988)..(3988): n is a, c, g, or t
  misc_feature (6069)..(6069): n is a, c, g, or t
  misc_feature (6350)..(6350): n is a, c, g, or t
ctgctataataattccagncaaattagcttcatgtcactgagtattccgggaaataaaagggcattttataataaacaaaggctcaaattgtcagaaagacatgacaaccataatgtgtgagtatataataacagagctccaaaatgctaaaaacaaacatcaacagaaataaagaaaaatacagataaatatatggtcttaagtatagattttgacactcctttctccaaaacttatagaacaaatagaaaaaatataatagatacatagaatatttccagaattgacctcattgatacttataatatagcacacccaataacttagaatacaatgcttttaagtacacagtggaccatagatgaatctaaatacatttgaaggtttgaaatcttatagtacctgttttctgatgataatagaattgaaatctggaatcaataaaaataaggtagttagaaaatcaccaaatatttgaaaattaaatagtagacctatttgatctgcagatcaaaaaaagaattgataaagagaacttagaaaatattcaaactgaataacaactcagcatatcaataattgtgggatacagctatggaagtaattgaagaggaatgtatagttttatatgtttatatnncaaaagaacatttaaagatataaaatcagtgatctaagtttctatcttaagaatacataaaaagaaaaaataaaccaaagtagaaagaaggaaataataaggataaangcatgatcagtaagttcaaaaacaaacagtagaaaaaattaacagggccaaaatttgacttttaaaagattaataaaattgatgaacctgtttcaaaactaattttaaaaagagagagtacacaaaataccaatatcagaaacaaaagtggggatatatcactatagacactagagataataaaaaagatattaagaaaatattatttacaaatttatgtgcataaattcaacaatttagggaaatgaataaattccttataaaataaaacttgccaaagtgatatggaagaaaaagaaaatctgcatagccacttatcaagtaattacatttaaattatcatttaaatctgttccacaaagaaactccagatctggctggttttactggtgagctctatcaacattttaaaaagaaattataactcttacacaaactctttctaaaaatagagaaggaaggctcatttctcaacttattttaggagctaacataactcgaacaccaaaacctggcaatgatactgttcaggaaaaaaacaaaagcaaaacaaaaacaaaaaaaattacagactgatactactgtggatatatatacacaagtatctctaacaaaatattagcaaattgaatctaaactacataaaaaagctaatacatcataatcaaggttataataatacatcatacctaatatatctaaggctgatttcataactgaaaataaatcaataaaatgcaacatattaacagaatgaacaggaaaagccatatgatcttcccagtagatgtgaggtgggaggtaggaattgaccctggaggttgtgcccagacactggaccaaattgaggactagctaaaacagggatagtgtggaagcagtttaccataagacatgcctgtgagtgtgccatgtcagtttaccattgtcatggcaacacccagaagttactaccactttccacggcaatgacccaacaacgcagaagttaccacgcttttcctagaaatttctgcataatctgccccttaatttgcatgtaattaaaagtggctaaaaatacacggccgactgcctctgagctgctactctgggcatgccccctatgggatagccctgctccgcaaggagcagcaactctgctgctactgtacactgctgctttaataaaagttgctgcctaggccaggtatgctggctcacacctgtaatcccagcattttgggaggctgaggcagggagatcacttgaggtcaggagttcaagaccagcctagccaacatggtgaaacctatctttactaaaaatacaaaaaaattagttaggtgtggtggcgcacacctatagtcccagttgggaggctaaggtggacggatcacttgaaccccagaggcagaggttgcagtgagctgagattgcgcttctttagtgttaataagctatggaagagaccaaaataaaactatctttgagttgataaactatcttaactctgtgtctgttttattaattaaaaaaaaagcaaattaatgcagctgtgatgcatgtaactggcaaaagcatctttgaatagaaaaaatacactgcacaaatgaaaatggtggcgagagcaatggggaatatgacttgtgtcctaaacctattaatggtaaccacatttcatgtcagaaacagctcattaaactaattttagatttggtgagggaattcngcaaacccctccacatgtgtgtgcaaactcctcagtgtgtgaacccactgcaaactcctccgtgtgtgtaaacccactgcaaaccctccacgtgtgcatgtaaacccactgcaaacccctttgtgtgtgtgcaaacccactggaaacccctccactgtgtgtgcaaacccactgcaaacccctccacatgtgtgtgcaaactcctcagtgtgtgaacccactgcaaaccccagtgtgtgcaaacccactgcaaacccctccacatgtgtgtgcaaactcctccgtgtgtgtaaacccactgcaaaccccttcgtgtgtgtgcaaacccactgcaaacccctccactgtgtgtgcaaacccctccacacttccttttttgtcctgcctgctgggaaaatgagttccctaggtttagattaatgggtggaacttcttgcgtctggcccacacccagagctggctagagcaacccgggagtggagatgtgtggtttccagccggacactgtcttctctccccagctcaggattttattagcctgtgtggacaaacattttgnaggatcagtgttccnaaggaaccatctgtgacaacaccccaggttcctgggacatctctagggacccaaactcttccttttatttcactagtctgtcctatttatatacaaatgtagtcccttgtttgcacttcttccagcgggaacagactcaaacgcttcccctcaccttgggccttggttggggcctttntgtggctctcttttgagattcttaaagatgctgtgaagggatgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttggccatgaaacccctttgcagaaattgcatttcctccctctagtggcctgtttgcatttgagttctgtgagcccctgcttcatcacttnttacacctgcccctccagggacaggcagccagggctggggtcaccagggtcccctcttgggccctccaacagcaacagtactggcaacagctgggatttgctgagcacagactctgcagcaggctcggttgagctctcttgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgngtggtcatttgtctcctttcatctgctgccttcaaccagctgggtcattagggctggggaacccagaccccacacagtcctcctcccagangccagacacagcctcacgccacagcaaggactccagtccccgaagcaaatgtccctgggcgtagaagctgcagggcccccaatccctggtgtgtactgctttgcactggtgattcaccctcattgcaaccttccctcttgccaccctaacagtgcttttggctccttaacaccccctcgcctggcacagagcagggcttggtgaggactcactggacacagcccatgtgtcctcctgccagttagcctccatcgggacttttttgaatgtctgttttttaggcccttggcctatattttctcaaggcttttgataaaatatttaaaaataattcacaaggagcctagaaactgcctggaaaaccaatttctgtcttcagttgtctctaattaatgtcttcatgttgcaagaagttccccttttttaatgctggagcatcgtgcgggggattccatggttttccccgtccccggccacctggactgggctggcttctggccgcccacccacgggcccctccgggagctgtttctgtgcgggtctcaggatggagcctgaaattcctcttcctcctgggagcctttcttctgaataaaaatgatatagtaaccaaaaaatctacgcaatagagatatggaaagtcaaggcttccctccctgaccttcagtcccatttgttagaggtaaacgttgttccatcattcatttgctcattcattcttttgttcacttggcaaatacttcttgagcatctttgattcaccaggcatgatgctaggctctgagcatactgcagtgaacaacacagccaccagtccctgtgcctcctgacattctggtgaggtttaacaggagtaaggctgggctcctggatagctttgaactgcaaagtggttgagactggctgagaatccattgaggagatgtcccactgggttgaataagagcagcaagaatttgaaccaggacagcaacttcagaaatgaaagaatgagaggagctctgtattgattcttaaaggaatgctgtaatcctactgcatgtgttagttatgtgttaattcaatctgatttcatcactttgtttgcgtttcttttctttactaacttgataaataattattggctttgaatttttacaatgcaacattgtattctcacttttagagtgtattgtgcattttatttgcatacaatggatttatatatgtgtgttcttttctgttttcaaatgaaatgggagcaagctacatttcgttattgagactgggttttggatatccttccgttctttttattgatgatctcccatgaggaacttttgtgtatttccaaggggttctgctattacaaaccatgctgatgtacttccttgtgcatacaagtggaagtatacacttgtgggagattgttttcagaataaattactaaaattgagtaatctgccacatgaaaaatgggctcaccactgttttggttacatttctttaatcatgatggcattgagcaccattttcacacttattggtaattcatatttctttttctgaaaactaactattcctgtcctttgttgatttttccatttgggtatttgtgtttttcttgttggtttgcaagagctctttgtatattaaggaaaatcacactctgattttcacacagtgttgtaaattttttttctagtttgtcatttgggagtttttaatggagtctctgctctacaaaaatagaatttagcattctgtttaaggcttttatgttttgtgttttatttaggaaagattataaaataattcacttattttcatgggttctggaactatttgttttaggaaatgacctaaaaatctcaatggcacctaccattcattttctgcctaacacatagtaggggctctacatgattatctgtaattgttataattacaaggaggtgatggttttcctatttgatagttgatgaagttgaggctcagggaaggcaaagaacttacctaagcaacatagttctaagccagtggttctccaacttgagtatgcatcagaatcacttggaggacttgttaaaatacagatgtcngccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggcagcgggcgcctgtagtcccagctactcgggaggctgaggcaggagaatggcgtgaacccgggaggcggagcttgcagtgagccgagatcgcgccactgcactccagcctgggcgacagagcgagactccgtctcn

SEQ ID NO: 400115 - DNA, 286 bp, Homo sapiens
catgaagtttctaatttaatttttactcttgtagtagaatagcacgtcattttgatcttctatttattcgcttatctctgtgaacttccttttcatctcattttgtttctttcatcatttcaactctgggtactgactttatttacatttctctcccttttttttccaagcaaagtaactttgtggcacatgtcctgctcctgctgggatgccttctattccatttgcttttctgtagactgaagtgacaggacagggatgcagagaaggaagctcagcccaggct

SEQ ID NO: 400116 - DNA, 331 bp, Homo sapiens
cctttatttctagaatgggctatgattctaatgtaatgatgatattccagaccgatgagcaaaacataatgtacccatattttatcacacataaaaatgtttacacaacattgcacatttttttttggcttggagtaaatctctatcagagagctttctttcttgattaatcaaaccatgagattagaatttttaaaatgtcttcctcttccttctcaaatcacttttatttttctttcagtggcatctccccgctgtcagcctcagccctctcctaccaaaatctctttcgaaataagttccaataaacgccagtggccatgtttggaaa

SEQ ID NO: 400117 - DNA, 454 bp, Homo sapiens
ttttatacattaaagtgtagaaagtgtattcatcttaaatgtccagtctgatcagcttttagatatgtagcacacccatattaagatttttaattcgtggaattggagatttagggtattactgaaagcccctttgtctacggcaagttaactatttatttcaggttggtggtgttgagcattgacttcatcatgctatatgtacctgaagcatgaatgaatgtactgttaaaaaagaatatatcatgaacacatccagccacgctgattgaccaggcagcctgtttaatagttatccatacttattttatgcttatttctaaaatggtccttcattctcttcatgtatagtttcaaatttgtgatgaatatactgatggttgttaaggttttcctgcctctagagtttattatgtttatcataaataaacataataaatttcttaacctcagc

SEQ ID NO: 400118 - DNA, 639 bp, Homo sapiens
tgaaaatctaacttagtcttctgtccatgctagtgaatgactccctcaattagtgaattcactatagcaatttgaatttttggtgctgctttacttatgcctgttccttacttcagtccagaacaacctgtttatttccacaagatagtagtatcacaagtgaaaacagatccagctaagtagacttgtatcctgttttgcaacagtttattggaggtggggctagtgttatggtggttggtaaaaagtagatcaggtgtttagattatgtgcatcttattcctgactattgtcggttgtacttttagacatgaatgctactgtgaacaaataaagaaaacaaggtacattgcatgcccattctgcaaatttgatggttttattagtatcacgaaggtggtgtggcagagtggaaaggctctgccattagtagcctgctgtatgaattaggaagttaacctctgtaaaattccagctctgtccttcataacattgaagactcctttctctactaacactatatttttttactgcttttccttgcaaaatatggttttagaagttagaacttaagaataattttcttttttcatacctcaaaacactttaaaagacagtttctaacttaatattaaaaac

SEQ ID NO: 400119 - DNA, 180 bp, Homo sapiens
atgattcctaagctctaatgggaaatgcctcctggtgggtggtatctaaaattcttgtcagcacctaggacagagatattcatagcactccagggatttcagagaggatggaaccttagcatggatagaagcatggatgctgttgaatgcatgtttggattaaaatcctcttttcattta

SEQ ID NO: 400120 - DNA, 440 bp, Homo sapiens
ttccttgggtatggtgcctggtgggtgtgcatgggtgtgccagaccacggcttaatgagtgccgcctctgttcagagaggcatgtgtgcattttgtctatgcgattagcccactgtgtggccttgggtaagaccccatgtctctctagcctcagtttccctaattataaagagttaacaaaagtatttccaagattctctttcatgctaacatgctgtgattctaagtttatttgtcattaaaatgagtctcagctgggcatttatttgtcattaaaatgactcattaaaatgagtctcagctgggcatagtggctcatgcctgtaatcccagcactttgggaggctgaggctgaaggattgatcgagcccaggagttggagaacagcctgggcaacatagtgagaccctgtcactaccaaaagaaaaaaaaagaaagca

SEQ ID NO: 400121 - DNA, 403 bp, Homo sapiens
ccccacactggtaccccgtcctcctgtgccagtctgacttcaccaaaggcccctgtgaaggcagttgagccaccatctgtctgtctttctttatgtgcccctcaggggctcccacctgcacaagtcatcaaggtgtcctcccagccatgagcttctctctgagccaggttctggcaaacccagatctctgtcccaggatggttccagctctgcctgagcctcctgtgtaggcagagccccaagtggctgcctgggggtttgactctcctccgccctcccagcacagcccattgtatggatgtggagaggcaaagtgatggagggagagctggcaggtggctcaggtgagggaagtcatgggggtagggctgggagcaaactggagaaggtgctacaaggaggg

SEQ ID NO: 400122 - DNA, 669 bp, Homo sapiens
cctcctgggtagttgggattgcaggcatgcaccaccacaaccagctaatttctaattttttgtgtggagatagggtctccctatcttgcccaggctgatttcaaacatttgagctcaagcgatctacctgccttggcctcccaaagtgttgggattacatccatgagccagtctgcatggccctttgatctgttccgagcagcagacacaaatttatgcgaccaatcatttattttactctttaaggtaaattcttaaaattctttaaattctttggtgctgattaaggtgagcacaaatctagtgaagtcatattaggatagccatgccatttgtgcagggaggtaaccactgtactgtgcagccttatgatgctggggcagtataaggaatccaaagattttctcttcctaacgagatgtttctttttttttttttttgagatggagtctcgctgtgttgcccaggctagagtgcagtggtgcaatctctgctcactgcaacctgcatctgctgggttcaagcaattctcgggactcagactcccgagtagctgggattataggcgcatgccaccactcccggctaatttttgtatttttagtagagacagggtttcacaatgttggcctggctggtctcgaactcctgacctcaagagatccaccc

SEQ ID NO: 400123 - DNA, 468 bp, Homo sapiens
caagacaactctatttgtaaatgtatgaaagcatttcatcaatgcagccaacattttctgagcagctgcatgtgataaaatggtgaggacagaagaatctagtagaggaagcagcttcaatacagtgccataataaaaacactgtacatggggcataatagaaacactgtacatataaagggcagtttattctgctgcagtgtgggagagcagggagagtggtttcaggtgagttgaatacaggggtggagagccagctacataggaagtaaaatttgaattagtaggcactgtttaatatcttcgatgtgttggggtgtttgtaaaaggaatgtaataagaaatactcaagaaaagtgtgagccactgcacctgacctactttttctttacatgtatttttactgctgagccaagaagaaaaaaaaaagaaaagaaaatccttaaagtgcattttcttctttaaaca

SEQ ID NO: 400124 - DNA, 236 bp, Homo sapiens
tcgccatgttggccaggctggtcttaaactcctggactcaagtgatctgcctgtctcagcttcccaaagtactgggattacaggtgtgtgccactgcacccggcctaaatttccatttttaaaaatgagtatgttgtttgtgtcttttgaggaagcatatcaaagaagtttggccacgtgcacagccgtatcttttttccatgactcaaaagaagatactcagaaggagatggaag

SEQ ID NO: 400125 - DNA, 416 bp, Homo sapiens
tggttccgccgcttttatagcttctcattctggctcctactgcttccttgaagatacttccctgcttgtagtcccctagccagaagttgatgcactgagaagaaaaggccctctgatcacagatcagagcttgtgaattattattattttttttatctctggtaacaagctgatagggtgagtgagaaggatcaaagagacatactttgatttatcactgagtaataatcctttcccaagaaagacaagttaattactttttgtcttagacccagttagggtcaccttacagtgcaggtggaaagaaagcaggactgctgagaggagctcaggacccattttccaggactattgccttctcaaaactttggagagcagtgaaaatagattcccaagtgaaagaggtggcagaaata

SEQ ID NO: 400126 - DNA, 336 bp, Homo sapiens
gaatcttatgggttcatgatggaaaagatgacaagcattaaggccaaaaataaatctgagtttgttcactggatgcaggaaaagttttcctaaccaaataatgtgggtaacatttcattattagcatggaaatatgtccactttcatgtttagagaaggaaatagtaaatgaatgatcaaacataaaagcaaaatacagcattcacagtaggtatccaatgtaacatgctatttagataaaaacagtcccttcaaagtccagtatgtttttaaaagcctgatatttacagttgtatgatttctagggaaattgagaaattaaatatatatccagca

SEQ ID NO: 400127 - DNA, 454 bp, Homo sapiens
aaactgctgctcttctccatctacactcactgcaatctcatggctttaagtgctgtctacacgctgagtattaaatcctaaatgtgtatctttagctgacaacctctcccttgaactctgcactcacataaccaacaatctaaacctctccctcccatatgctaccccatctcagtaaatggcaacttcattcttctagttgctcaagtcaaaaagccttgtaaggccgggtgtggtggcccacgcctgtaatcccaacattttgggaggccgaggcaggcagatcacttgaggccagaagttcaagaccagactggacaacacggcaaaaccgcatctctactaaaaatacaaaaattagccaggtgtcgtgaccctgggaggcggagcttgcagtgaaccgagatggtgccactgcactccagcctgggcgagagagcgagactctgcctaa

SEQ ID NO: 400128 - DNA, 586 bp, Homo sapiens
ccatttttcctgagtctttttaaaaaatagtttttattaaatattgagaggtataaaatatttaaaatatgtaaattttaaagaataaaaatacaatacaaatctttgtatctttcacccaagttttagaagaacctttgcgatccccactgagtaaaggtaacaccactgctctgaattttatcatttcctattcgtcagagttgtatcacatatttgaatctgtaaaaatacattgtttggtttctcatgcttttcagcacgcagacatgtctgtttttttgcgcttcactttactgtgctctgtagagactatatttttcacaaattgaaggtctgtggcaaccctgcatcgagcaagtctgtcagcgccgtttatccacagcatgtgctcactttgtgtgtgtgtgtcacgttttggtagttctcataacatctcatattttttcgttattatatgttatggtggtctgtgatcagtgatctttgatgttactactgtaattgttttggggcatcaagaactacacccgtatgaggcagcagatttaatgtataaatgtgtgtgtgctgactgcaaaaaaaa

SEQ ID NO: 400129 - DNA, 452 bp, Homo sapiens
gggcacagtccttttttagtgttgatatcggctaccataaaggacaaagttactactaatgtaagttggccaaattaagacaaagaaaaactgaggagaacatgttcattttcctatttttttttcagttttgctcaagtctgcttcagttaagccagagactcaacttcctttgcaaaagaaaaggacttttcctgcagtttattacagcctgtcagaggtattaggcaactaagaaactcattttgaaatctagcagcaatatttaatcagacattttgaaacttacttatttgtgagcatgggctgattagtcattagtccatcgagatgtcttatttaaggggaaagagtgggcgattttaggtgagatggtcctgaagtaagaaccagatgcctgttaaagttcatcaatagaaacccccacggtttatgggccccttgcgatatag

SEQ ID NO: 400130 - DNA, 296 bp, Homo sapiens
taatacaaaatttcatttgtgataggactaataaagaaattcagctagtagtgggatctgtcgtggactgagtttgattccaagaacagaagaggcaggaccagtgagaaatagcacagacatatttgcaaaagcagccctcccacgttaggaagaagggatacttttgcacagtgaacagcactacaactgctcatctctttcatgtactatcacacatggaatgactgagatactcctgtgttccacacatagtcctccctgcccctactgaatagagaaacccaatttcacct

SEQ ID NO: 400131 - DNA, 860 bp, Homo sapiens
gcacgagattcctttcatgctgattcgtgtcattgggaatctctcttcttcagcttcaagagagccgaatctgactcaggtgttgagattggggaatggcatttccatttcttcctctctccagtatagccagagcaggaagggcaagagaaaaggggtcctggtacctggtgatgtcaaagtaggcagctcctactgctgtgctagcaagagccatgtggactagtgtgagaacaggaactctcccaagtcccctactgggtaaccagatacccaacagtgtgcctagagatgctttagtccactccaatcctaaatactactacattgtgctaatagtttccctgaaaaacagccatatttcactcatttttttaaaaatcaattacaatttttagccttaaggtttgatattggtattgtgtttattttttcaaagaatctttatcttgtagagttatacactgcaatagttacagatgaaaagatagtgtggtctgggatttgtctcaaaaccagtaggaggtaggagtggtgggctacaggtatatagatgaaacaagattgccttgtttatactattctatctactttgtacctgttttctatgttataaaatgttcatagtaagtggtttaaacttcaaaaatcatttctgaaaataagtggatacccttatttactcagctgtgctataaatttcatattaaccccccaaaactagaccagtctgagtgtttctaataaaatccagcagtaaccgtgactgattttaaaacattcactgcttctcttatctacaatgcctagcttcattagtcatgtagaaaatgcttacattccccaagcttttaaaaatt

SEQ ID NO: 400132 - DNA, 377 bp, Homo sapiens
tcggtacccgacgctctctctgtggggcgggcccgtacggaggtaggagtggtgggctacaggtatatagatgaaacaagattgccttgtttatactattctatctactttgtacctgttttctatgttataaaatgttcatagtaagtggtttaaacttcaaaaatcatttctgaaaataagtggatacccttatttactcagctgtgctataaatttcatattaaccccccaaaactagaccagtctgagtgtttctaataaaatccagcagtaaccgtgactgattttaaaacattcactgcttctcttatctacaatgcctagcttcattagtcatgtagaaaatgcttacattccccaagcttttaaaaatt

SEQ ID NO: 400133 - DNA, 1193 bp, Homo sapiens
tttctccattgtgaattccctgatgttgaacaagtttgtatttgtacctgaaagctttcctggttcactgcacttgtaatgactttttctgctgtgaaaggcctccccacatttggtgctgatgtgtggcttcaatccagttgtgagtggcctatgttggagaaggtacagttgccaggaaaatccttcccaactttcccacaggcgaaaggccttcctgacacttaaaatctgcagcctttcacagagaaagcattgtccacgtctctattccattgtgttccttctggtgctggtgcatgtttgcactaaaccagaattgtttcccacatgcctcacaagtgtactatttctgcccagatagcgttccttgttgctcagccagatacaaaatgtcccttaagaccagaacacacatctcacagggatgagccttctggatgaatggacctagctgtgacactttctactgaaacacttcactgagggtgtctgctttccctttgctccacaccaacaacctggcgaggttatataggcaaagttctctgcatcacggggcacagctctcaggctcatcaaggaaactccattcctctcagaagtcattaaaggtcggctatgttcataaagatcatactgagatggcttctctttctgtaggtggagcgagctgggacttgcaggtgaccaagaagggggatcccggaaccggaattgtctcccctggcgttccggaagtagaagcagagtcattgctgggtggcgccagccctcagacttgcctctttgcagtaggaagaaggcctccccacataccttcccacactcatcaccttaagccagactcggtgtccagtgaatatgaccatctcttgcccattttctaatgagtgttttcattaatgagttataagaatgtggtgggtaaatctatgggctttgaactagtgaatcaacttggtttcagaatctggcactgctacttactagtgaatttaagcaagttatttcacctttcagagtgtcagttccctcatgcatacaaggaagataaaaaataatgtatacaaaagtattggagtaattaatacatggagaactacatgtaaagcgtttagcatgatgtctgacatattaagcatccaatattagttgcttgcagaattattagtaaaagagattgcttctga

SEQ ID NO: 400134 - DNA, 446 bp, Homo sapiens
gatacttttagaaggagtaataattattaatcccaacaaatgacattcttcagtgtctaagcattttcttttgtgattaaagagctgccgtgaacaaacctggaggagaacgtgatgggtaccagagaccagaaatttacacatggctatgttttcaaaggacaggtcaagatgttccagctacttgggaagctgagacaggatatctgcttgagcccaggagttcgtggctgcagagagctgtgatcacaccaccgcactccagccagggcaacagagtgagaccctgactccaaaagcaaaaacaaaagagcaaaaacgagattccaatgtatactcccaccaattaatttgaaggtgaccatatccctcctatcaaatactgtcactcatttacatctttgccaaatgtgggtaagaaaagaaataaatagtttttttattta

SEQ ID NO: 400135 - DNA, 1025 bp, Homo sapiens
gatacttttagaaggagtaataattattaatcccaacaaatgacattcttcagtgtctaagcattttcttttgtgattaaagagctgccgtgaacaaacctggaggagaacgtgatgggtaccagagaccagaaatttacacatggctatgttttcaaaggacaggtcaagatgttccagctacttgggaagctgagacaggatatctgcttgagcccaggagttcgtggctgcagagagctgtgatcacaccaccgcactccagccagggcaacagagtgagaccctgactccaaaagcaaaaacaaaagagcaaaaacgagattccaatgtatactcccaccaattaatttgaaggtgaccatatccctcctatcaaatactgtcactcatttacatctttgccaaatgtgggaaaacataaagtttcgcaaccctatattgactccaccatgccttgggaaaggcagcccgcatcagtggcaggaaatattggtggagcgagctgggacttgcaggtgaccaagaagggggatcccggaaccggaattgtctcccctggcgttccggaagtagaagcagagtcattgctgggtggcgccagccctcagacttgcctctttgcagtaggaagaaggcctccccacataccttcccacactcatcaccttaagccagactcggtgtccagtgaatatgaccatctcttgcccattttctaatgagtgttttcattaatgagttataagaatgtggtgggtaaatctatgggctttgaactagtgaatcaacttggtttcagaatctggcactgctacttactagtgaatttaagcaagttatttcacctttcagagtgtcagttccctcatgcatacaaggaagataaaaaataatgtatacaaaagtattggagtaattaatacatggagaactacatgtaaagcgtttagcatgatgtctgacatattaagcatccaatattagttgcttgcagaattattagtaaaagagattgcttctga

SEQ ID NO: 400136 - DNA, 416 bp, Homo sapiens
gccagcttgtggattgatacattcaaatgaatgaattgaggttccaaatgtgtaatgtaaacaagtcagcagaaagtaggagctacttggagcagggtgctggtccgggagggctgtggctgagtagggagataaactttggatccaaacagatgggttggcaaaactaatctgtggtcaatcagttcacaaaataaacgctttgctacaggaccaaatccctgaaatcgaacataattcaattcactgaaatcaatttgcaagtttatcagttgggtgaattacctatgttctaaaatgtgtttcggttaacttaataaagtgcctagcaatttcaggtgcagggactggttttaacagcctctgaggatattcccaagtgtcttgaaagaataaaaacatcttgcgtactttga

SEQ ID NO: 400137 - DNA, 455 bp, Homo sapiens
agttcctccacatcttttcatggcttcatagctcatttcattttggcactgaataatattccattgtctggatgtatcacagtttatccattatctactgaaggacatcttggttgcttctaaattttgacatttataaataatgctgctatatattataaacatttgtgctatggcagctataaagctgccatgttatatttttataaatgctatagatatatataggtgattgtatgtacacactatatatagcacatctgtgtgtacatttgtgtgtggcataaaatgtcaacactccagaatgtttacatcaccccaaaagaaacctgtaacctattagcagtcacttactattcctctcaccttttcccccaacccctggcacctacttatctattttttgtctccatggatttgcatattctggatatttcatataaatgaattcacac

SEQ ID NO: 400138 - DNA, 226 bp, Homo sapiens
tagtgcataaatatgaatacacatggttcaaggaaaaataaaacttcatcatgttggaagtacacttggaaagctggttgttaaatatttgtaaatactgcaggatggcaggtcaaaaagataattaagaagaacctcagtagctggaagaacacacagaactttctagtcgtccttacctgaacaactatgggagaaataaactcctagactatttggatcaaag

SEQ ID NO: 400139 - DNA, 443 bp, Homo sapiens
cacatagaaatacagatagacccccattccatggaatccaatattcccagacattatcctcaatatgtgtcctccaaccacaacatattttttttataaggaagaatttgtaactgaagtgctgcccccatgcacacaatttcacctgtagtcctctaaagttgcttgaatattcttacagattccaggtgcctcagggatgaaatacagattgctgtccagggcaccagcgaatgctgcacccgttcttggcatatcatccttctcgtaaaaggcaatcatggcaggaaaactgagaccaatggctttttcattctccacctctcagctctccatagtaacggcactggttcttctcattgtgtattccttttcagatgcatactttctccctttaacaacttttttatatataatttaaaaaataaattattcccagaaag

SEQ ID NO: 400140 - DNA, 557 bp, Homo sapiens
cattattcagatatacacaccacagaggatgtcagtgatgaattgggcaatctggatgatataagacaaatgagtggtctgagtgtgcaccctcctgcaggaggcaaatccacgaaaaacagcattggaatcttcagaatatttactgggtcaagaaagaatacaaaagagacatactatcagaaacattggtgcaaattgttttaaaagtcaaatcagtctactaaactaaccaccaagctagttattcatacattcaaagagtatgaatataatctaaaaacattactgaaaagatttatcacatcgctttataactgaaagtaaaagcctggttattaaattcaaagttgactttggagacaaatgcaaatcattatattggtcatatatgtaaatatttctccctactttttttcttatgaaatcaattattaaaatatttgacttattttctgttcctagatttaactgtaaagatcgactgctcaaagttccaaacaccctgaagattatactaacaataaaagcataagtttcctaacacaagttattca

SEQ ID NO: 400141 - DNA, 444 bp, Homo sapiens
acatcacagagggaaatcgcccatctggcaatcccattcgctccaacagctccgggggaaaaaaagctgtgctctctcctccttaaaacatttctcagggcaaattatgtgcatctaaaataaacagtcttcttattgatcgcttcaaagtcaacaagttccaaatgcaaaattcaatcaaatctttcctatcgtgtaagtgtggtgtgtatttagctcaatagtcaccagagtccaaccagacgtgtatgtcgcgcaacgggtcttgtagttcctctcttcgtattcacatttgtgttaggagagagcagtgaccacggccacactacagacccctggcagctttgccccactgttatttcttttttcatattctctctttccttctttctctcttttcaggaggaattaacggtcatggggtaaacatagcaacaaccaaaa

SEQ ID NO: 400142 - DNA, 484 bp, Homo sapiens
aattcaaactttcagttgaacccattgaaagcctacattttaggagtaagggtgagtaagaaacatgagtcctcagtgactgaaacccagtctccaagtatttcaatctttgatctatctttactctgattgcctaccaaaagtaaaagtaaatactctgtggaggaagatattatccagagtcttaaaattatctaaagtttgtatacacgatatgtggcatgcagtaaaaaattaccaggcatatcagcaagcacaaccaaatcattgaaaaccaagagaaaaattcaacagcaaaaacaaaatcaaaaaagggaaaataaaaaccaggcagtcagtagaaacagacccgcaggagttcgcagtatgaaatttttatgaatggactttaatcgtgtgatttgttcaagaaagtagacatatgaaggatttcagcaaacaactggaatctatacaaaactgtcaaatagaatttccaggagca

SEQ ID NO: 400143 - DNA, 1138 bp, Homo sapiens
gatcactgcgatggtcttctagcagcctcctccccatactcaagtccctgccccgcaatcagttttgcagatgcagccggagtgtaagcaccccaaactacctcctgcagtttctgtttcctcttcccccaccatctcctacctaggcagaggagctcagtaattcctccactgcttatggactaaagttcaagttccttattatgctgggctcttcctaaagaattcaatgcagtgggtaacagcttggcattggagttgcagagtcctgtgttcaaatggctctgcccccaagagctgtgacttcaggtaactacatctttgagcctcatttccccatctataagtaagagctgcctcgtcgtaagagttgccaagaggattaaacgacacaagtccacactcccttctctgaaacccctggagccagatgtgctttggaatccaagacattttgggttttagaaaggtaatactgtgcagataacattcccgaggggttttgtacaataccctgtaatcaaatacatgaatactctactacatgtatgagtaatgtgagtagtacaggtgtccctcagtatccatgggagtttggttccaggatcccaggggatgccaaaatcctcagatgatcaagtcccttatataaaagtggtacattggtaagaattaaagatcatagcctcatgccacttcaagtcaagttgtgtgacaaacaggttcctaaaaagcttttggttgtcagagcttggtagatttcagggtcatgggtaaggactgtgggtgtggatttacccatgctcatcccaatgcccaacagacagcatcctccgcgtggccagatgagtggctcttgtggaaactcagggcagagcttctcttgccacctcggctttactgcaagaatgttctggcactgcagtgccatatatacctccctcttaagaactgggacttttcttggtgccatagagctcagagaaaaccagaaatgagagactgtcaaaactggcctggccctgtagaagtgtttttttggatggactcaataataagcatatgttaaaaatgtaaacttacaaggcaggtttctatgaataaactaccaattttagtgttttatccacagaagatt

SEQ ID NO: 400144 - DNA, 347 bp, Homo sapiens
gcaatctgtagcttgagcagcttcccaggtggttctcctacacagccaactttgaaaaccactgctggcctggagcggtggctcatgcctgtaatcccagcactttgggaggccgaggcgggcggatcacgaggtcaggcgatcgagaccatcgtggctaacatggtgaaaccccgtctctgctaaaaatacaaaaagttagccgggcgtggtggtgggcgcctgtagtcccagttacttgggaggctgaggcaggagaatggcatgaacccaggaggaagagcttgcagtgagccgatatcgcgccactgcactccagcctgggcgacagagcgagactccgtctc

SEQ ID NO: 400145 - DNA, 440 bp, Homo sapiens
tgatcagaatggtcagagccagacaaccccacagaagtgcagcacgttgatttctgactatttatacaaccccataggacactccccattcactgaggctggctggtgggagacaactcttaagtgtaagagaaagatgcacgttggctagcagggagcacttcatcatcatgatggaaggaagaccactcattaacttgttggacttgtggaccacttcttgcctcatgttgaccaaaaccatgtgaataggtttttagctgtagctgctccttagccctcagagttctgggaatagtagagaccctggaactagtgttgaaggaagtgccctgctttccatcccctatgcactcagaccatgagagcagctcttccatgatataaaaatgtgaagacgttacatatgtactccattaaattgaatcagtgtcctctta

SEQ ID NO: 400146 - DNA, 943 bp, Homo sapiens
tgaaattttttccgtggcttactttaaaaaacacacctctttttatttgaaataactgtaggttcacaggaagttacaaagacggcctatgtacctttatccagttgctccatcataaaattcccctgtcagaaccaggaatccacattggtacagtgtgtgtggtccagggtcattctgtcacacaggtggactcccacaaccctcactgcaatgatacagaactgtttcctcacccggagggcccttgtgctgcctctttctagtcacacctcctgctttcctctactcttccccagtccctgaaaccacgactctatgattttgtttccatctctgattttgttatttcaagaatgtcatataaatggaatcacacggtatgtgaccttttgagatgggcttttttcatttggcatgatgccttggcttatgcttctctattaagtctcttacactgatcgtccccagataaaagtggattgcattctgatagctcctcaatgatctctgaatgccagtattttatgattcactacatattctatattctgtacgcctttcttaattcaacatagactcttgctaagaatggctttgtgtacccaaacaggatagaaggctttttattacactgctcattcagctctcagtgaccttgcaagaaaggctggaagcccattttatagagggagaaatataaaaagtaatttgctcagaccccatagctgttaagtagtagagtggaaatgagacctctggtctgcatagctccaagccttctgctcttttcatgacagcagggctgcaggaacacagtggtacaggtgtatgccagtgactttttcatgcactcgagcgtttattaagtaccacttgtatcaacatcagagttggtataccagtatacttaaatatagaaggtaaagaaatggagagagtc

SEQ ID NO: 400147 - DNA, 344 bp, Homo sapiens
tttagtggcattaagcatattaagaaatacattgttaatatggaactgatggcacgggtatcaatttgagtcagatagatctggatttgaaccacagatgttacaatcatcagaaaatataaggctattagccctatgaaataatttaaataacatgaatatgaaacatagggtggatggtaaatttgccttttcctgtttagtaatataaagtgagttacactatattatttttcctttaaaaagcatattttaggcagggtgtggtggctcacatctgttaagtccagcattttgggaggctgaggtgggtggatcacttgagcctgggagttcgagaccag

SEQ ID NO: 400148 - DNA, 338 bp, Homo sapiens
atgggggtagggtggggaggacaattgctttgcttacatttaagagagatgtccaggggaggcaagagttggacctcagcctgctggggtttgaccagtatagtcagcatgctcacatggtagactctcataccagcaccaatgttcaatgtcagttcaagtgtgaaccccttttgaggacctcttaaacactgtatgatacatgaatcaaaattcagctattaaaattgtgaatagagatatacaattgcatatgttaattgatcattgtcatttgtgtacagtttgtcttaactattttaaacttgcctaaaaacaagaatctctagaaataaaaa

SEQ ID NO: 400149 - DNA, 450 bp, Homo sapiens
ccagctttgctgtgggagtgtgtgttctggtggctgagtctccccatcttatgctctggagattcagagttttccatctggttcacagtgtaggctgctgccaccacttcttttaaaggatctgtggtttttttcagttcttctgttaaattcttgtgttgcttcttgtgaaaaaaagttcacagtgtgaatctctacacatactttgtttttccaagtaggagaggtatgctaacactgtctccagtccaccatcatgtcttggtatcctccctacagtactcccagtatctgcaggtcacagagccacagaggctgtggcagagccacctggatcctctaggattggaggaaacagagcaatggagataggacctggagttgggagggcagatgctcagaaattattattaactgttatcactctgttacttatttttgaggttgttc

SEQ ID NO: 400150 - DNA, 340 bp, Homo sapiens
tcttatttcatagtcatgcattgcaggaatgtgcgtactgcataaagtgacttgctttatcaggtttgaaattcataatacagtcagaagatgattaacagatttgttcaaatttttatgctacgatatgttcttgtccccatgtgaataaatgcaacagattgtttgtaaccattttaattgctctgattttacatggacaatagttttgtataagaaaagacaaaaaaggccaggcccggtggctcacaactgtaatcctagcactttgggaggccgaggtgggtggatcacttggggttaggagtttaaaaccagcctggctaacatggtaaaatcc

SEQ ID NO: 400151 - DNA, 623 bp, Homo sapiens
ttcagatgatccgcccgcctcggcctcccaaagtgctgggattacagacgtgagccactgcccccggcctcaaatttcatttccacaataatgctaaatatttatcattattttttaaagttgaactttatttgaattattgaagtttgtagaatggtcagttcctcagtaaactgagtaaaatatttaaaactcatccccaaaacggttggcaggccaattttagtacttagctttccaaaacatacccttcttcaaaggtcactttatagttaaccactgtaaagtaaataagcattgaaattgatgttaatgattgttttcaacctctccaaaagaaatccattgtcaaacaggaagaagggattaccaataccttctgtctctaacttaattcttttatgattttgctggttgtaattcatttagataggatcttaaaaagcaatatcgggcagatgggattacttaatgacagctgaggggtattttttttttaattatctggtgataaaggtgaggctgttgttttcacactgaatggccagttaacaacttatctcttcctttttcaaataaacagactgataaaagacagcaacctaacaaaaagtgagaaaaag

SEQ ID NO: 400152 - DNA, 396 bp, Homo sapiens
tgaacgtggtctggtatacaacaggtgatccatatttcttgaatataaggatggatgaatgaatgaatgaatgggtgaaacctggggaagaggaatcaagaactttgttaaaatgagtactagttggccgggcatggtggctcacatctgtaatcctagcactttgggaagccgaggtgggcagatcaaggtcaggagttcaagacaagcctgaccaacatggaggaacaccgtctctactaaaaatacaaaattagctgggcgtggtggcacacacctgtaatcccagctacttgggaggctgagggatgagaatggcttgaacctgggaggtggaggttgcgatgagccgagattgtgccattgcactccagcctgggcaacaggggagaaact

SEQ ID NO: 400153 - DNA, 492 bp, Homo sapiens
taatcccaacactttgggaggccgaggcaggtgcaccacaaggtcaggagttcgagaccagcctggccaagatggtgaaaacctgtctctactaaaagtacaaaaaaattagccaggcatggtggctactgtaatcccagctactcaggaggctgaggcagaagaattgcttgaatccaggaggcaggggttgcagtgagccgagatcgcaccactgcactctagcctgggtgacagagaaaaactccatctcaaaaaaaaaaaaaaaaaaaaagatttaatcttcatcatgcctaattatcattcttttatttttaaaaattgtaacaatagttacacaagtaatccatgaatacaattatcttttttgaaaaaaatcagaaaaatagaaacaatttcacaaatttttattattctttcttagaaaccctactaatctctgtatacaccaccaccatcagctaccttttattttaactttttattcttact

SEQ ID NO: 400154 - DNA, 380 bp, Homo sapiens
tcagtccctaaaaccacacctggcacatggtaggtagctggtactatttgttgaattactaagtgaatgccattgttatgcttaaaatctttggatggaggctgggtgcagtggctcatgcctgtaatcccagcactttgggaggccaaggtgggcggatcacgaggtcaggagttcaagaccggcctggccaatatggtgaaatcccatttctactaaaaatacaaaaaatagctgggcgtggtggtggactgctgtcatcccagctatttgggaggctgaggcaggagaattgtttgaacccgggaggcagagcttgcagtgagccgagatcacaccactgcactccagcctgggcaacagagccagactccatctta

SEQ ID NO: 400155 - DNA, 451 bp, Homo sapiens
cagaatgcaccgccgcatttggcgaatgaatgaacgaccgaaccagtaatcactcctaagaccaagaaggccacatccttccccgtggggcctccttttccgaggccaaaccttcagcccaggcccgagctccggcctctaccgcctaagtcgactctcggccggcgcgttccgctctagaaggctctggcacaggcgggcggtgccgggcgccagcttctgcgggcgtgggccggccagggcgcgtgggcctggggactcggggccacggtcgtcacgtgagctcatccccgaggcggcagcgtggccggcacccgcccgctggcctggtccggcgagcgtgggcggcgaacgggtccccgccggatgcacgctggtgggatccagggccagagggcgccgccggggaaggtcacctagacgcgcggcccgccgggcctccacgcggccg

SEQ ID NO: 400156 - DNA, 669 bp, Homo sapiens
gttcttataaaatgactttcttccctgttgctttagtaactgagaattgaaaggcactttcccaatgggccattactgcagaatcagtggccccagacgacaactctccctgtggcggggttcttagagcagatggtataggcaacatgggggatattacagagatgatgttagaagcaattattgcaccattgggtgtcggtattctgtgcttcctgacgcatgggaacctatattgtacagcacttcagaactgtaaaagcttatgcagctaaaccagtgagacattggtaagaagtctgagcttcattcttgattatttgacaaaggtgaattattttctgatcattttgaaatttgccaagatctctgattaggattttttaaaacagaaagaattctggattattttttccatctggctatgaatccagtggtatttgccttaagttttctaccatctccaattaccggccaaaaaaaaaagaaagtctattgttttagagatgtcttcgaaaactggtaataatattgtatgcaaatcagttcaaaaagatataatagtttcctattgctactgtaacacattgccacaaattgagtggtgtttttattcttttatgagatggtcagtctgatgtggccacagaagaaacagggagactcagg

SEQ ID NO: 400157 - DNA, 419 bp, Homo sapiens
ggagaccaggcaagtcgccatagagtgggtggcattgcacaaaagtctaaaggaaggaaggaggcttggggctgtgtatcagaagagcgtttcaggcaaggagaacagaaaagacaaaggcccaggagaggccagcgtgcctggacactagtgaagactggggctttcagccagaggtgaggttgcagggtgagggcacatttaactgccgacttccaggtcaaacctaaagaatacccaaacttgtcttaattttaaaacgagagatgtgggctgggcacagtggctcacacctgtcatcctagcacatgggaggccaaggcaggcagatcacttgaagtcaagagttcgagaccagcctggccaacatggcaaaaccccgtctctactaaaaatacaaaaattagccaggtgtggtg

SEQ ID NO: 400158 - DNA, 114 bp, Homo sapiens
tgtaaagacagggtctcactatatttcccaggctaactgaatgctcctgtcatgaaagggtgtcagactttgtcaaatgctatttttctatcgagatgaacatgtagtttttat

SEQ ID NO: 400159 - DNA, 439 bp, Homo sapiens
acagaccctgtcctcacctgcatcacaccaatgatggcgtcacagcgtgggttccggtcaccagtcggcctcccccaccaacgtggactccttacaagcagagccaccaacgtggacacgatcccatcaggaaccacctacttttgcatccccagcactgtgctcaggtcccagggaggccccagcaaactgtggaacaaccaaactcgtgactgaatgaacaagtatgttaagtcgttaagtaaaaatagcagaagacttagtagaatgtatgagtaacaattacaattatatgaaaatccgtatccacgtgaaggtattatgcaaaaaaagcttaactttgtttcagtgcctttccagttaaatgttgttaagcagtatttcccccaaaaggtgcatcttttataaaacaagaacgcaaggctttgaggcaaaaaaa

SEQ ID NO: 400160 - DNA, 459 bp, Homo sapiens
gtagatacagagttttgccatgttggccaggctggtctcaaactcccgacctcaggttatctgctcgccttggcctcccaaagtgctgagattacaggtgtgcaccactgcacctggccagaaataaattttcttctacaaaacagatttattattttttaaagacacaggggaaaagatgatctttaactgtttttccaaaggtatcttttggtgcgtgtgcgtgcgtgcatgcgtgtgtgcgtgtgtgcgtgtggtgtgtgtgtgtgtgtgtgtgtgtgtgtgtgtgtgtggtttaaaccttggctatattgtgagggtgctgttggatactcagttagcccagggatgctagggcaatcatgattcagaaggaaaaaggaagcaaggtgtttgggttttgactgtcattaatacttagtccagagctttcacagtgaagcccctggctgacatgac

SEQ ID NO: 400161 - DNA, 283 bp, Homo sapiens
ccgtctcaaacaaaacaaaaccaagtagcagatatgcatgatgaacaagcctagagatctaatgtacaacataaggaccacagtataggtaataaattctactttatttgggattcctccttcactgtagtaatctttttttaactatgtatgtatctcataacatgttgtataccttaaatatattcaacgaagcttattttaaaaaatgaaatgtataatgatgactggaaagggtggtagtcacatggaaataatgaagcagaataaaagttccagatat

SEQ ID NO: 400162 - DNA, 320 bp, Homo sapiens
tgtgtatgagcatgggttgtgtgtatatggacactgttcatgtctgtttctataacaggtaaccaaagtctgtatatggtagggtggtgtatatgcaggcttgtgaatgtactccagttgcatgtcccaggctctgcatgtgtagggggtagtagtatgttttcttgagattttattttattttattatttatttatttatttttgagatggagtcttgctctgtcacgcaggctggagtgcagtagcggtgagctgagatggtgccactgcactccatccagcctggtgacagagcgaggctccctctaaaagaaaaac

SEQ ID NO: 400163 - DNA, 590 bp, Homo sapiens
tttttttttgtgagatggagtctcactctgtcacccagtctcaggctgggatgcagtagcacaatcttggctcactgcaaccgccgcctcccaggttcaagtgattctcctgcctcagcctcctgagtagctgggactacaggcccgtaccaccacgcccagctaatgtttgtggttttagtagagatggggtttcccaatgttggcaaggctggtctcagactcctgacctcaagtaatctgcctgccttggcctcccaaagtgctgggattacaggcgtgagccactgcgcctagccaaaaatctcctttcttaatccccagtgccacctgtaatccaatcaacaaataattattgagcacctactatatgccagattctgtgctaggtcctctacacacattttctctaattcccacaacgaagctgtattggaggtataattatccttattttgggtaggtcacaaaattagtgggtaagccctggcatccaaacacaacattactggctattggccacatttcttgcctattagtgacttctgggtggaagtggcccttctccagaagtactccatccctacctt

SEQ ID NO: 400164 - DNA, 367 bp, Homo sapiens
agctgattacatggtaatagaaatttgtattacttaggatttatgacaattactttgcagcttaaaagataaactcaaggcatttgttctacaaattcaccacctattacagtttctcctgtttatgaagtttatatacatggaatcatatattcttttgtcttttgcttctctcagtcgactaacattgtaagagtcagcttcaagagtggctgggcttgtgcacaagtcattcacggtcctgttgatacgtttctggcttttactatacaaacgatgctcctgtgaatacttctgttgagtgtctcacgtaaggtctatagctaggagtctcactgttgtgtcacagggcacatcttcattagtt

SEQ ID NO: 400165 - DNA, 586 bp, Homo sapiens
ttacagatgtggaatgctgaggctgagaaaggttaaggagcctgcccagggtcatgtgctgaagaagtggaggagctggagctgggctggagctcatgtctgcggtctgttctgagccaagacgagcactcaaggtagggcatcgagctggagggggaggtactgcccgacgccacccactgccactgctgttccaggctgtgctcactctgcctccctgtccggcatgtctgtgccttccctggggctggaagcagggtatcttatgtgacaaaagccttctttccaaagccttagaaataacagtgtgtagccaagtgtggtggctcacaatccagtgctttgagaggccacggttggaggattgcatgaggccaggagtttgagaccagcctaggcaacataatgagacctttttaaaaaattaaaaattaattagctgggtgtagtggcacacacttgtagtcccaactactcaggggcctgagacaggaggatcacttgagcccaggaggtcaagagtgcagtgagctatgatcatgccattgcattccagcctgggtgacaaagtgagaccctttctcta

SEQ ID NO: 400166 - DNA, 384 bp, Homo sapiens
aaatctcttttcctcaccattgattccagtctgaactaatgatccagatgtgttgtgcatgtccttcctcttctacaaagtgactcgggaagcagtttttatgctatttgtagaaaggaagcattttctggagcggggccttctctgcttctgctacaccttaactccctagattagaggagagctgtgaggccgcaaggaggggggcctggagaggggcttgggctgagggtggtagaggtctctgaggactgtccttgtcttctgcctcctgtgtttatttggagaaaagcccatttaacaaatgtacaggtctttacctctatccctcttggggctgtctgccatgtatctttcattgtaccaactcagatggaccaagtg

SEQ ID NO: 400167 - DNA, 468 bp, Homo sapiens
caggctcaagcaatcctcccacctgagcctcccgagtagctgggactacaggctcaccaccacacctgactaattttttgttttgttttgtttttttgagatggagtcttgctctgttgctcaggctggagtgcagcggtgcaatctcagctcactgcaacctctgcctcccaggttcaagcgattctcctgtctcagcctcctgagtagctgggataacaggtgtgcatccaccatatccggctaatttttgtatttttagtagaggtggggttttaccatgttggccaggctgggcttgaactcctgacctcaaggtaatcccagtgctttgggaggccaatgtgggaggatcacttgtgcctagcctaggttacagagcaaaccctgttttgttactaatttttatgagatggggtctggttctgtcccccaggctagagtgcagtggggccatcacagcttact

SEQ ID NO: 400168 - DNA, 1016 bp, Homo sapiens
gtcacataagagacagagcaagtaaaatattacgctacagtgctactggcccataatcaggcaactgcagagtcttagggggttatctaatgtagtcttggggtggctggatagacttcccaaagaaggtgatgccgaagctgaggtcggaaattacgaagatcagctatcaaacttggaaatcatgtcttagagatcaaggagccaagagatgagacaagcctgggttcctaggtgatagggtgtggctgtgtccccacccaaatctcgtcttgaattgtagctcccataatccccacatgttgtggagggaccctgtggaaggaaggcctgaggagagaagacacatagtcatgctgactaaaccagatcacctagaattaccaaatggaaagattgtgcctgcagcctggcctgttgcccacagcggtctacctgccacactgggaaagatcgagcagagacagagaagaaaaggaggctccatttttcaggctgctctcccgcaggctcatgttttgtgttcatgccaggcagagaacacaaaatgttccaataaataagtatcaaaggttagtggtgaaaatgaaggaggaagaggcattgcgtgaaaaactaaacatgcaaaatattacacacaaagagaaccaaaatgcaggttcactggaaatgatagacaatatgttaaaacaagaggagagaagagagctgaaataatcaaatggaaacacacaatttagggctaagatcttgttgtgttcagccacaaatgatgggcagcagtgaggaatctgtgtgttctccacactcttcgctcctgggaagtcaactcacatggaccatgatatcaatatctggtccttcccctaatatctgtttgaccttgggtcagttacttaaacttcctaagccttagttctttgtctggaaacatagggatagttatacctacaacacaacactttgtaaggaatatgttggaaattatatgcaaattggcttccgttggtgtttgg

SEQ ID NO: 400169 - DNA, 862 bp, Homo sapiens
gtcacataagagacagagcaagtaaaatattacgctacagtgctactggcccataatcaggcaactgcagagtcttagggggttatctaatgtagtcttggggtggctggatagacttcccaaagaaggtgatgccgaagctgaggtcggaaattacgaagatcagctatgaaggcctgaggagagaagacacatagtcatgctgactaaaccagatcacctagaattaccaaatggaaagattgtgcctgcagcctggcctgttgcccacagcggtctacctgccacactgggaaagatcgagcagagacagagaagaaaaggaggctccatttttcaggctgctctcccgcaggctcatgttttgtgttcatgccaggcagagaacacaaaatgttccaataaataagtatcaaaggttagtggtgaaaatgaaggaggaagaggcattgcgtgaaaaactaaacatgcaaaatattacacacaaagagaaccaaaatgcaggttcactggaaatgatagacaatatgttaaaacaagaggagagaagagagctgaaataatcaaatggaaacacacaatttagggctaagatcttgttgtgttcagccacaaatgatgggcagcagtgaggaatctgtgtgttctccacactcttcgctcctgggaagtcaactcacatggaccatgatatcaatatctggtccttcccctaatatctgtttgaccttgggtcagttacttaaacttcctaagccttagttctttgtctggaaacatagggatagttatacctacaacacaacactttgtaaggaatatgttggaaattatatgcaaattggcttccgttggtgtttgg

SEQ ID NO: 400170 - DNA, 945 bp, Homo sapiens
gtcacataagagacagagcaagtaaaatattacgctacagtgctactggcccataatcaggcaactgcagagtcttagggggttatctaatgtagtcttggggtggctggatagacttcccaaagaaggtgatgccgaagctgaggtcggaaattacgaagatcagctatcaaacttggaaatcatgtcttagagatcaaggagccaagagatgagacaagcctgggttcctaggtgatagggtgtggctgtgtccccacccaaatctcgtcttgaattgtagctcccataatccccacatgttgtggagggaccctgtggaagattgtgcctgcagcctggcctgttgcccacagcggtctacctgccacactgggaaagatcgagcagagacagagaagaaaaggaggctccatttttcaggctgctctcccgcaggctcatgttttgtgttcatgccaggcagagaacacaaaatgttccaataaataagtatcaaaggttagtggtgaaaatgaaggaggaagaggcattgcgtgaaaaactaaacatgcaaaatattacacacaaagagaaccaaaatgcaggttcactggaaatgatagacaatatgttaaaacaagaggagagaagagagctgaaataatcaaatggaaacacacaatttagggctaagatcttgttgtgttcagccacaaatgatgggcagcagtgaggaatctgtgtgttctccacactcttcgctcctgggaagtcaactcacatggaccatgatatcaatatctggtccttcccctaatatctgtttgaccttgggtcagttacttaaacttcctaagccttagttctttgtctggaaacatagggatagttatacctacaacacaacactttgtaaggaatatgttggaaattatatgcaaattggcttccgttggtgtttgg

SEQ ID NO: 400171 - DNA, 474 bp, Homo sapiens
ctcgtgtgtgtatgcatgtgtgtcttcttgcacctgtctaccacagccagatggagccttctgtgaacagacttcttcagccacagaaaagtactggggatctctctggagtttgccctagcactggttcccatttttgaacacttttgaaatattagggtatttttgtcctgaaaaacacctgctacaattgcatacatgagtagttttgggccctttattgaagggtggatgcagaaagtgaatttgcttaattctggagcatagcattcaatgccatttttgttttctttggctttaggaaggcctgaggagagaagacacatagtcatgctgactaaaccagatcacctagaattaccaaatggaaagataagaaaaatcacccacaaatttgtaataatatttactcacttttcaaaggtttctccaactttttgagtcaggactaatcatctttaaattaatttcttt

SEQ ID NO: 400172 - DNA, 417 bp, Homo sapiens
aacacagggattgggaggagtggggtagcattaggccaggttcatggcccagtgctgctgtctctggactttctgctctctctggacctgtttgctagctgagctcatccatttgcataattttcagtgccatttctcagctgatgagtcctgaacttttgtcttgagtctagacttctccttcaaacagcagtcttaaacactcaacttctttcttgttttttccacttgtcaacccatgaacacctcaatcttgttacatcgcgaggggtggggtggtggggggggggggggtgggggggagggctggtaaggcccaggtggctattattattgttcgagtgtgggaggattacttgaggccaggagtttgaagccagcctggaaaacacagtgagactccctgtctaccaaaaa

SEQ ID NO: 400173 - DNA, 104 bp, Homo sapiens
agcaaaaaaacaacttgttaaatgtcagggctttgtgtttttgcctttgggcttttgccatgcctggttattgggcaccttctggtaataaacagttgaaagga

SEQ ID NO: 400174 - DNA, 647 bp, Homo sapiens
aaatttcagttttaaaaaatgtgttaaggcttcatttttggcctaacttgtggtctatataggagaatgctgtatgagctattgagaaggctgtgtatcctgatgttgttgaggagtgttctctataccttcattagaaataattgttttttactgccttctagtcctctgttcccttattaatattctgtcttgttttattattacagaaaatgaagtattgaaatatcctactataattatattgctctctgtgtgtattcaattttgtatttgctttatatatttgaaactctaatctgagacacacacatgcaaatacatacatgtataaacaaatttgtcatagattcccagtgaaagaatacatatattgtttaaagcccttctttgccttcttgaagttttgacttaaagtacattttataaaatatgacattttcttacttaagatgcagcttgtgtaatattattttgagctcttttgctctaatttggttaatatttacatgaaatttctacttccatcttgccactttcagtctttttttatcattagatctcaactgactcttgtaaaaaggcaagttgaatcttgatttttaaaattttttaataaacctttttatttaaagtatgtctcttga

SEQ ID NO: 400175 - DNA, 906 bp, Homo sapiens
  misc_feature (763)..(763): n is a, c, g, or t
  misc_feature (770)..(770): n is a, c, g, or t
  misc_feature (775)..(776): n is a, c, g, or t
  misc_feature (786)..(786): n is a, c, g, or t
cgcctttgcggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagccacagagctgcatctcttgaagctgtgagctatgccattgatactttaaaagccaaggtgcccatatggaaaaaggaatattgagagtctcatgggaaggacacaaaggntttgggntccannggaacacttntttgagcatgggactactggtaccatttctgcccttgggtttcccctcggaggtctggccctcttttggaaggggaaaacaacgggggggtagcacagggggcgagagacggccttccag

SEQ ID NO: 400176 - DNA, 1513 bp, Homo sapiens
  misc_feature (48)..(48): n is a, c, g, or t
  misc_feature (59)..(60): n is a, c, g, or t
  misc_feature (224)..(227): n is a, c, g, or t
  misc_feature (229)..(229): n is a, c, g, or t
  misc_feature (231)..(231): n is a, c, g, or t
  misc_feature (233)..(234): n is a, c, g, or t
  misc_feature (237)..(238): n is a, c, g, or t
  misc_feature (242)..(242): n is a, c, g, or t
ctctccgagaactcttgtcagctcacggcagcaaggacggactcgttntgaaggcgccnncaccttttatgaccacctctttcccagattattcgttttgatgaagctaaaattttaatctaaaaagaaatgcacctcatggagaattcttgtgaagaactgtgcttcatctgtggatttctacacccttgatcatttgcaaacctgtaattatttcgtaaagnnnngntngnncgnngtgncaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagccacagagctgcatctcttgaagctgtgagctatgccattgatactttaaaagccaaggtgcccatatggaaaaaggaaatatacgaagagtcatcaacttggaaagggaaacaaagagtgcttttgggcatccaacagttaatcacttatgttttagagcatgcaatcttaactttgttaaactattattattgatcacattttgattttttctctccacatcaggatagttactgaagcacaatctcttatactagtgggccacaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagttt

SEQ ID NO: 400177 - DNA, 1327 bp, Homo sapiens
cgcctttgcggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaagatgttataaactttactgccgagaaactttcagtagatgaagtctcacagttggtgatttctccgctctgtggtgcaatatccctatttgtagggactacaagaaataactttgaagggaaaaaagtcattagcttagaatatgaagcatatctacccatggcggaaaatgaagtcagaaagatttgtagtgacattaggcagaaatggccagtcaaacacatagcagtgttccatagacttggcttggttccagtgtcagaagcaagcataatcattgctgtgtcctcagccacagagctgcatctcttgaagctgtgagctatgccattgatactttaaaagccaaggtgcccatatggaaaaaggaaatatacgaagagtcatcaacttggaaagggaaacaaagagtgcttttgggcatccaacagttaatcacttatgttttagagcatgcaatcttaactttgttaaactattattattgatcacattttgattttttctctccacatcaggatagttactgaagcacaatctcttatactagtgggccacaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagttt

SEQ ID NO: 400178 - DNA, 289 bp, Homo sapiens
ttttcttttattgatttagtcatctgcaggtatcagggcattaatacatgaccccagttctcctctgacctctgtgcacccaggtatcaggacaaatagtctgcacacttacacccactcaaggtggtttagttaagaagtgtgaccacccaagtcactgaacttgaggatgccccaaagatgtcaagtcatcctcttaggaagatctggcctcggccataatgggaaagagaacagggaaacacccaacattttggagctctgggggaagtcaaagctctgtgctggg

SEQ ID NO: 400179 - DNA, 357 bp, Homo sapiens
agaaagatgcccgtttggccaggctggtggcttgatgggtgtacctggagagggggtctggcttcctgcccaagatgcctcccagccctgccagggcccggtgcagcgggcagggcctcatctgtgctgtagtggtcgagtggttgctgcaaggagcgtagttctgccatgtctgggggccaggttccactctgcacatgaatatgcagtctgggaggccccactgctctcactgggaaggaccaatgttgcacctctgttaatgcctgacttcagctgctggtgttctgatggagccagaggcttggggaatctggaacttgcctgctaaataaggtcgtggtggactctcagcca

SEQ ID NO: 400180 - DNA, 612 bp, Homo sapiens
gcccggtcagcaggtgaccctgccgggtattgtgtttccttgtaatattttccccctgtttctgtggtaaccttccctggaggccccaggccttagggctacaggaaggtgcccccagacagccctttccttagaggcctgagtattaggaggagtccccagatctagccacctccctaacccttttggctccctaggatcaggggcctgggaatctaggcgagtggcctgagtgagcatggactcgcgggctgggggaaggccctttggcgtcttctggggggaagggagagggaaagaggggagctggacgcccggaagggccctgagcaacttgagtcgctggcctagcctcttgtttcctcccaacccatccccactgccctcctccagtctccctcctcctacaagggagaggtgggtagcatgctgcctggggcaaggggcaggggtgggggtggcagaggtgggagggatgttttcatcagcagagcatagctcctttggtcctggaccagttcccagaggcaaaataaattcaggacagcgtctgtttagtgtgggtctgcatttccgctcccccagaaccctgtgtattcttgatgtgggggg

SEQ ID NO: 400181 - DNA, 445 bp, Homo sapiens
cagtagatatagccaaagacctatccctccagggaaacatctaaaaagaaaaaatcaagaaaaattgtcaaaatcaactttgtcaaaaccccggaaaacagtcaaaggtttatatcaattgtctgaacattaaatcaagaaaaaagaaactcaaaaccaggaagaaagttttgcagctttttgacttgccttggccccaccctcctctccagctcagcataggtcttgaagacaacagcctgccctctcagtatgacacctcattttttgatcagattcttattctaaaaacaaagtgtgtctgttctaacttgtctggtggctacctgaaggactaatgcaagtcactttcccttgttcctcacctagtctgaactcactcagaactgaaaagcagctaacaaatgttcaagcagtaaggcaaacaaacaacccagagccacct

SEQ ID NO: 400182 - DNA, 166 bp, Homo sapiens
gcatctggatgatgtcaaaagtccacgttgtgtgctggcctaacctgaaagaccctatctagttctagcctttaaattccttctgtcaccaaatctagagttacatggcatctgtacaagctaggtagctgaggcatgggatcagccctataaaggagcttttgga

SEQ ID NO: 400183 - DNA, 432 bp, Homo sapiens
acagttttttgtttttgtatttttttttttgagacagagtctcactctgtcacccaggctggagtgcagtggcggtatctcagctcactcactgcaatctccactcccctgggttcaagcgattctcatgcctcagcctccccagtagctgggactacaggcatgtgccaccatgcccagctaatttttgtattcttagtagagacagggtttcaccatgttggccaggctggtctcaaactcctgacctcaagtgatccacctgcctcggcctcccaaagttctggaattacaggagtgagccactgcacctggcccaaaagacagtattttgttcctttttatggctgaatagtattccatggtgtaaaaatctattgtaataaaatttttaaaaaatcttggtttacctgtaatccatttgtaccatgc

SEQ ID NO: 400184 - DNA, 433 bp, Homo sapiens
gctactcacaaactccctcttatgcattctctgttctacttggacttggctatctctcccagagattataatctctgcttttaacaacttagcttctggctgacatttgaccaaccaggaatatgttcctctcaccacctgtccaattgtgctctttttacaacaaggcctagtagaatgagtgcatgagatccagtcaagccacaccatgcaacacttgccatccccagcacaaagagccattcatgagtcactacttcatatggatagctcatgtcaaaccctcttgccctatttagattgtaaattccacgatggtaaggaatctggatttgtcttctttgcaaccctaaaagacatgtggatagacagaacatattttcaaagactcatagaactctaagttggtttaaaataaaacagaactttaaag

SEQ ID NO: 400185 - DNA, 267 bp, Homo sapiens
ccaggaggcggaacttgccgtgagcggagatcacgccatcgcactccagcttaggagctcgcagtgagtggagatcacgccattgcactccaacccaggaggcggaacttgccatgagcggagatgacgccatcgcactccagcctaggagctcgcagtgagtggagatcacgccattgcactccaacccaggaggcggagcttgctgtgagcggagatcacgccattgcactccagcccgggcgacagggcgagacgggagtctca

SEQ ID NO: 400186 - DNA, 653 bp, Homo sapiens
ctgcactcagcctgggtgacagaggaaggcatgaaaagcctggtagtgtgatgacgagtcttgaagtatgatttattaactaaaagctaatgtattgccttagaaacgtaggcatgtaaaggaagtaatgtttttaaaaagttctagtatttcactgatttttttgtgtgaaatgcaggaatttcagttttattccctggaggtgggaagtagtctcaaggctggggcttttttgactttggatctgccagtgaaacctagacagtacccacttggttaccaagacagaaaaggaaactttgattgattattcaaattcaaagcaggatgctagggaacagcagatttaaggttagttggatgactggaatttagcatataaagatgtgtgaagacacccgtgtggaaaggacatttctattcccagaagcatcactcccttctcagagtgagcagccacacgtaaaagcagaaggaaagcaagagaggtaggataactgagatggtagatataaaatccttagcacaggccaggtgcagtggctgacacttgtaatcccaacactttgggaggcgaagtcaggaggatccctcaagcccaggagtacgaaaccagcctgggcaacatagcgtgtctctacaaaattaaaaaa

SEQ ID NO: 400187 - DNA, 724 bp, Homo sapiens
attgaaccagcactaataaagagcttctagaggagtgacagatctctaatgatgtagctctgagacaaggacaggaagatactaagaaccatggccttgaaaaccctggggtaagatgtccatgctggactgtggctgagttgttcactttgaaggggccaattcaaagttgaacatgatcctgaggtttgcgcacgatcctgaaggaaggagtattctcaaacatagaccagatgaatttcacatcagccgggagagttgtgagcttagaagagattaactttgatttagagaaatataggaatataacatatcttacatcacaaaggtttctaaaaggttacacataatgcaaatagaagacatagaggtgactacttaaagaactaagtgaaaatgaactaaagggaaatgaaaatacaatttatcaaaatttatgggatgtgacaaaagcagtgtttacagagaaatttatagcattaaaatgcatatattgattaagatctaaaatcaataatctaagcttccactttaggaaactagaaaagaacaaattaaatccaaaataagcaaaaaaaaaaatacttaaaattagagcagagatcaatgaaattgaaagtaagaaaatgatagagaaaaaccagtgaaaccaaaagctggttctttaaatagatcaataaaaattaatagagtcaataaaatagatctataaaattaataaggc

SEQ ID NO: 400188 - DNA, 620 bp, Homo sapiens
agactccatctcaaaaagaaaaaaaatatatatatatatatttataatataaatatcatattatatattatatttatataaatacatatatttataatacttatatattatagtatataaatatataaatgtatattaagatatacttttaaaatatatatatacatataaaatgtttgcttatatttggaaatctttgccagacatttcattgcttgtcatatggacaaatgatgaaagtaaataattttgtggagtggagtgctgaggctagcttataccggctcacaagaggaaattgttaagttttaaggactgttgtgagctgacagttgaccaccaaaatgagtgatttagacctaagtcgtgaatcatcaaagtttattcagccaagtagagggtatgcctgggaaaacaggagtcacagaagcttctgtgactgtattttcccaaagaggtttattatttatacattttcctttaaaaaggttggggggtgcgccaggagtggtggctcatgcctgtaatcccagcacttaaggaggctgagatggactgatcacttgagcccaagagttcaagaccagcctaggcaacgtagcagaactccatctctacaa

SEQ ID NO: 400189 - DNA, 570 bp, Homo sapiens
attttaagataaattgatgaatgttaacaatattacaaacacatacacttatatctctgttgcccaaacatgataaccctgcctcacttgtccctttgtgccccgtgtttccacacctctgactgccttttgcttctttttcacagctcacaggttctctccccagtgggccttcctcaaccaggtaaggcagcattggtctctcctacttctgtgttcccatagcaacctgccctcagtgtctaaccaatgcacccaccacactgcaatgtaactattgcttacttattagaaacaggctatgagctcccagagggcaagggttgtatcacaattgactataagccccaggtactcttcatcagccctggtaatgggttagatgctcaataaatgctcatcagatcaacaaggcagctacttggccattgctgatttgagctgcacttccatagtttacagtgttgtgggaagtagctgcctagccagggaaaacatttcctagcatcccttgcatccaggtgagtcctgcccaaagttcttcctaaagaaaattggacagaaaataac

SEQ ID NO: 400190 - DNA, 401 bp, Homo sapiens
tcatcataatattttctgacatgtgaacattatatgaaattcaattttaatgtttatcaataataaagttttattggaacacactatgtaatgtctgtttaagtagatatttatgtaggctactttctctctacaacattaaaatggagtagttgtgacagatcgtatggcttacaagcctgaaatatttattatccggccatttacagaatcagtttgctgacccatgctctaaggcagtaattctcaatcctagctggacactggaatcacttggggagctctatagaatactgattcctgattcccaccctcagaaattctgacttaattggcctgtagtacaatctagagaatccttaacgtataaacttacctaatttgtcctatctaaagaaaac

SEQ ID NO: 400191 - DNA, 613 bp, Homo sapiens
gcctttgtctctggctgcagtcgtagctccaggtcttttcttctctgttctgtgtcttctgctcctagaggcccagcttctgtgtccctgtgacctgtaggtattgggagatccacagctaagatgccaggaccccctgggaagcctagaaaaatggttctgcctgcaaagaagattgtgacatattgctggttgcaacaccacggtgatgttactttttgccttctcactgccctcagaaggcattgtgatatgttggtggtcccagcttcaaagaaatacttgtctgcagcgcagattgctacatattgcttggcccagctcctatgtgatgtgactctcctgtcatacctgagtgctccccactgcggtaattgtgacatatagctgggctctggccctagtttatgtaacttttcttcctgactgctactcacctgggggcattgtgacatatctctgaacctctcacctaagtgatgtgaatctcctgcttgagcccacttctcagggagtattattatatattgtcacacacagcaactaggtgatatgactctctctacagcttggactctgcccaataaaaaactgtgatgtatcactggaccca

SEQ ID NO: 400192 - DNA, 725 bp, Homo sapiens
gcctttgtctctggctgcagtcgtagctccaggtcttttcttctctgttctgtgtcttctgctcctagaggcccagcttctgtgtccctgtgacctgtaggtattgggagatccacagctaagatgccaggaccccctgggaagcctagaaaaatgattacaggcgtgagctaccgtgtccaggcttttttagatattaagattgtctttgcccaacccagcttatttcttggagacacattgctggtcagccaatcagatgctgccattgagggtgaagcacagaaataatttctgccacctgtattctctaagatttgtgaaagaaaaagtagtatccccaaagacaaaaaacccaaacatgaccccagtgaaatggtgcaagaacttgcaaagtaaaaagcatctggggcactcactgaggcatagggcagtgtctcctgagagggtggtctttgagaacttaaataagtaggatggggtgggagaatctttcaagtgattagatggcctgatttgacacgtgagtcagacacatttgttttctcatcagtactgccactctttaggtttgttaccttgaaaaaatttgttcacttattttgacttcagcttttaaactgtaacttgcattttattagtgggacttaaaaggtaagaaaatgttcacaaagggtatcaaagaggtgggtttcagagtaaattaatacctaatttcatactcc

SEQ ID NO: 400193 - DNA, 551 bp, Homo sapiens
gcctttgtctctggctgcagtcgtagctccaggtcttttcttctctgttctgtgtcttctgctcctagaggcccagcttctgtgtccctgtgacctgtaggtattgggagatccacagctaagatgccaggaccccctgggaagcctagaaaaatggttctgcctgcaaagaagattgtgacatattgctggttgcaacaccacggtgatgttactttttgccttctcactgccctcagaaggcattgtgatatgttggtggtcccagcttcaaagaaatgtaagtatcctctctggacccttcccacaaagggcattgtaacatatctctgcacccatcaactatttgatatgactctcttctctgacctgggctctgcccacaggagtcattgtgacatgtttctgggcccgtcacctagttgatgtgactctcctctgcctaggccctgtccatgatggggattgtgacatactgcctgatcaagcacctaaatggtgtgacccttttctcatgcctggaccctgcccaataaagcaattttaacata

SEQ ID NO: 400194 - DNA, 326 bp, Homo sapiens
tctgtccggagcctaacctagaggaaaaaggggagcagagaccagtgaggccagggctagttgggagaggggcaggggctgcctattgaaaggttttgaattttgcgggtccccaggcttcaatgaccttctggtcccaagtgactgattattctgaccaatgctgacacctcctgccttccgtttatgatcatacaaacgttccaattatgaaaataatatgtgttgcgtataagaattcaggccatacagaaagggaaaaatgaaaatccttcctaaacctgtgagagaaactaaccaatgttaacattccatttgtagtcttc

SEQ ID NO: 400195 - DNA, 774 bp, Homo sapiens
gcccccggacttaagaaagacccgcagcctcaaggggccccagcccagggggaggcacacacacattacagcgccggatgcagggtatgctgcaagaggagctgcagccggtgtagcctgtgggtagcctgtggacagcctggggccgtgattcgtggttggccgggtagttggcaagggcgccaaccgggcaggtgagcacaagcagggctttgtaaaacgagtaggaagctacagcaagggccaagtggctcaggcacagaaacgaagcagccacatgcaaaggtgtgggtattcccggtgtctaacttatgtccctcccgcggttcacagaaggcccctgacactgggactacacggagcagaaagtggcacccctttgcctcaggcacctcagtctcctcggggcttgggggcattttcagaagccacccgcagaaccagcgtcccgggcggcggctggttttcccctctttcccgggggcccccctctgtcgctgcggggtgcagcggcggcgagagatatccgcagctggcacccggtgtcccgggagggagaatcggggtctgtcgcgggccctgcgaccaggaggcgactgtgccctcagcagctgccccgcgcccgccccgccctcaggccactagaggcaacctcgcagcgactccggtgccccaagtctccctggcagggcgggctgtccccaccggccagggcaggcagcgggcggccgcttgctctgcacccgcagactccgcgccagccgcgccttcccg

SEQ ID NO: 400196 - DNA, 376 bp, Homo sapiens
tttttttttgcataaaacaaagttgttcatacctcacaaactgaatggaaccaatccctcattatggttatgtattggttaagaatactgggtctatggtcaggcgcggtggctcatgcctgtaatcccggcactttgggaggccatggcaggtggatcatttgaggtcaggagttcaagaccagcctggccaacatgttgaaaccctatctctattaaaaatacaaaaactagccgggtggtggtggtgcatcctgtaatcccagatactcaggaggctgaggtgggagaattgcttgaacctgggagggggaggttgcggtgagctgagatcacaccaccacactccagtctggacgacagtgagaccctgtct

SEQ ID NO: 400197 - DNA, 346 bp, Homo sapiens
agcattagtgaagtttctggtccaaggcacaggcttcctaaaagactgagacttaatcataggagtataaaatgctccccctcccctacataatacatcacattactaaaggcttatttatcacagttctgtttagctagtgcatcatgtcttctatcaaaaagaaattacaaggcacaccaaaatgaaaaaaaaaaaaacaaaaaacagagcaaacatcagaaccagatacggcaaggatgttggaaccatggttagtgggtgcagcacaccagcatggcacatgtatacataggtaactaacctgcacaatgtgcacatgtatcctaaaactttaaagtataat

SEQ ID NO: 400198 - DNA, 627 bp, Homo sapiens
aatgatagcattattataatccagaaaataaaagaaatatccatccatctgtattgatataaatacttaaacacctgggagggaaaggacaggtcttccttacagtagaaatccaattataaattaataagtaaatatggaaatggagactcaccattaggcaaatatcatggtaataattgtttaaaagaactatcaatggatattaaaataagtgggtgaaagtgtcatgagaaaaaagattttttgcataattttgaagtattttcccagaagataattaataattgctaagagaaacatcacaactggtgtggaaaaataaacctggcaggcaccaccttaaccagatgatcaattacagatgataatatcaccagtaataagacatagtgacataccatgtgccactagtgtggtatattgacaagggcacctattgctttagttctgtttttgctcaaaatacatcacctcaatctaataattagaaaacatcagagaaatccaagttgaggggcatatgacaaaatcagtgcccagtacgcttcaaaagtgtcaatgtcaaggtcataaaatacaaataaagacagaagcaacttgtcaaagacaaacagattggattat

SEQ ID NO: 400199 - DNA, 527 bp, Homo sapiens
cggggaggagaagaagttattatcagggtgggggtgggctgagggcatggttcaaggcctgatgtctttgcctcctaatgccgggggtcttgctggctgggtcaggccactcacaggaatgggccataatccttggttgacaataaatggacaaagcagctgggtgcggtggctcatgcctgtaatcccaacactttgggaggccaaggtgggtggatcacgaggtcaggagttcgagaccagcctagccaacatagtgaaaccccgtctcaactaaaaacacaaaaaattagctgagtgtggtgcgggcacctgtaatctcagctactcgggaggctgaggcagaagaatcgcttgaactcaggaggcagaggttgcagtgatgagagaatgtgccactgcactccagcctgggcaacagagtgagactctgtcaaaaaaaaaaaaaaaaaattagctgagcgtggtgcgggcacctgtaatctcagctactcgggaggctgaggcagaagaatcgcttgaactca

SEQ ID NO: 400200 - DNA, 468 bp, Homo sapiens
aaattcctgatctgcagaaactgtgagagataatcaatgtttattgttgtagtaagccgcgaagatttgaggtaatttgttgtgaggcaatgaataactaagattttccttctgcccattgtccctctccaagctccctacactccagccaaactgaaccactgaccaaagcaacaaattttaggcccggtgcggtggctcatgcctgtaatcccagcactttgggaggctgaggtgggcagattacctgacgtcaggggttcaagaccagttggctaacatggagaaaccccatttctactaaaaatacaaaaaaatagctgggcgtggtggcgcatgcctgtaatcccagctactcaggaggctgaggcaggagaatcgcttgaacccggtaggcagaggttgcagtgagccgagatcatgccattgcaccccagcttgggcaacaagagtaaaactctgtctcag

SEQ ID NO: 400201 - DNA, 409 bp, Homo sapiens
accaaacatagaatattaaaacaatcaccaaatgtaattcacagtattacaaaaataattctaaaatatagcaatgaatcatcaccccaatacatctcctttcaccaacaaactcacggcaagcaggtcctaggaacaatgtccaggacattcaaaagcaaccaacacacggcataactgacaacagaaggatcagagttctagagtattacctacatttcctatttaccatttagatggatgacaactacacgtcatcctaaaaatgcaattagcttaccacttcagaagctagagagagagatggtatggctagcttttgtaagagttgaggaacagatggaataaaaagcagaaagaaattcagcaacgacagtctgccccataaaatgcataactcacaagtaca

SEQ ID NO: 400202 - DNA, 428 bp, Homo sapiens
tcccacatgtgtcttgctcgttcactaaacaaatatttgtgcttggcaccagttgatatgttggcattgtgtttcatctgattgtgtgttatttaaaaaactcctattactaaatccattaagcaaccaaactgctagagtcactagattaaaatgcatgacacacaactacaggaaaatgtcaggaaatgcaaatctaggcaggcgtcctcagacatatcagctatgaggaaactctctctaggagatctgtgttttcctcccaaaagaagatcatctttccagaaaaagaggattttacagtcaatttgctaacataatataaatttgtctccttccggggacttatatatgttagtacataattggtgtctttattgatggctgtaagaaccaatacctccaaaataaacagaatttgtacaata

SEQ ID NO: 400203 - DNA, 569 bp, Homo sapiens
gccatacggtttgagaatatagatatgtattcattaaaagtaccttacacaattgtactgatgattcttcctattactgagaagtaacaaacagaattaccataggaagaattgctaccatagtggaatggcagtgaatgaaaaatggtttccattgcttaaagcttcctaattcataggcatattctttttaagtctgtatatattacccttacaatgtccacacaaaatggaacatggttaaaaagagtatatttagaagcataagaaacatctcatttaggatgctttagactaaaacagaagaactaactccagatggtccaaatataacccaaagcccagaggtagagaagtcccagggaaggttgattcagtggtccaaggatgctaccaaagattcttttttcttccccctgtattgctaaactaccaatcctttgggctgatatccaaatagctctatcatactaatataccataccctcaagaagtctgcacaaactaattatgacattcccaaaaggaactaaaggactagaagatagtatattcccctatctcccacc

SEQ ID NO: 400204 - DNA, 462 bp, Homo sapiens
ccacattcagcgggtgggaattatgatgtctattttaatataaggaaatacagggacggaagttagaaccttcccacagccatgtagctatcaatgacagatccagagttagtgctctttcaagttggccgcatcacttgctacctccctgtgacagaataagttagagaaaaacgactggaacctctttcttctgccaccattccccaactctcctcagaacccccagaatctactccttgcctagttttatcaataatgacatagtgaagaaggaaaaaaaaaggctcttgagagaatgtaggaggtttaaatccggaaaaggcaaagggaaaaggagagaagaacagatttccaaagccaaagtatccattccccagtgcaagtggcctgcacactcccagacctcagagatggaagagaagctggcggtcgagaagctgtggcggtcggggtaccgag

SEQ ID NO: 400205 - DNA, 196 bp, Homo sapiens
tccaccttcaagcctcagtcatcccatctgaacatggagggtcggactgcatctgagctttgcaaataatgacccaaggaatggagatactccggggtttccacatcaggaattatttttcatcaaataaaaaaaatctcagctgcttgagggaccccttttccatgaaatattttatgtgtaaaaaaattttatt

SEQ ID NO: 400206 - DNA, 340 bp, Homo sapiens
atttcaaacacacacacacaccccccaggatgagcatagcttcaaaaacatactagagaataaaatcccatttgcattctttcccaagagataaccctggaggttgagggttttcttttaggaccatagccagagacatgggaagatgcaacagtccttgttcctggctaaatgccattccaggattgcatgtgctgtagagcctggctgggtaccaccagcccttttaatgtaagaatgaagcaacctggtattatttagttttgagttacatgcagagtgaccagcaaaatctgtatacttcttcaaacagctcaatgtgacagtattcctcttggta

SEQ ID NO: 400207 - DNA, 427 bp, Homo sapiens
ccccatttctcttctttttctaatcaatcctttccataacattctgttaaattggggtaatagaacttaaagctcagatctcagcttcagtctggactgtttaacattaaattacataaatacaaaaaaaactttcatatttatttttcctctttgtcctaaaatgaatgtctgtgagtcatagttctgtcatgttaaaaattcatcagtataactaggtcctgtttcaaaaaatacaaacaaatgtaagataaggagcaatttaaaattttacatagtctttaattcccagaactcctatatattttaccttcttgtcccagatgggatcactttggctgcagagtagaaaacagagtggagggaggccaaggagctgccagggatcagcaggaggggactgctctggcctagggaggggcggccg

SEQ ID NO: 400208 - DNA, 406 bp, Homo sapiens
aaaagcagtgtaatgaattttatatgtttgaggtatgtatttaatgtctaagatttttcttaggtgttgtggaaagtgaataggtgaggcccagtgtggataagaaaaaaaataacttaaaaggctgcacgcctataatcccagcactttgggaggccaggtgaggcaggaggatcacttgagtccaggagtttgagaccagcctgggtgacatagtgagatcctgtctctacaaaaaatacagcgaaatgagtcgggcttaatggtatgcacctgtagtaccagctacttgggaggctgaagtgggaggatcaccctgggaagctgaggctgcagtgagctgaaatcgcaccattgcactctagcctgggtgacagagtggtgagatgctgtctcaaaaaaaaaa

SEQ ID NO: 400209 - DNA, 538 bp, Homo sapiens
cccgcatcggcgtaaggcatggtggtgtgcacctgtatcccagctacacccagctatgtttgggaagccgaggcaggaggatcacttgagcccaagagttggagatcagcctgggaaacatcgtaagactccctcttaaaagaaaaaaaaagatgaataacaacacacatcttttacctggattttatattagtttattaggttagtttcccagacagggattgaccatgtcaaatgataaaattaaaatacttttaaagttttcaaagccgtactgctaaattactttccaggaagttacaccaactttttaagtttactaatagtgaatgagaatgcctgtatcagtacacccttgctaacactgagtattaatattacgattattttagtatgctaatttaaatattttaaatggccaggcatagtggctcatgcttgtaatcccaggactttgggagactgagctgggaggattgtttgagcccaggagttcaagaccagcctgggcaataaagcaagaccctgtctccacaac

SEQ ID NO: 400210 - DNA, 467 bp, Homo sapiens
cttaaaattcaaaatcttttaaggaaattaaaagacagtagaatttttcctctttgccttctgacttgggtgttgatgttctagcaattagaaacttcattagtggccatatggccaaatgatctcattatggacctttgaattaatttgcatttttattatgcttctgcttctaaattgtatgtactgtgtttgatcatttgtgtacttttcagagaattggagaattcttattttattgaagaatatatatttttagatggaacataagtagtatgtgcattccaaatttaaaaattttttaatcactagattattaacaaaaacaaaaataaaaccaagttatttgtttcattggatatgcctcctaacaatttccatgcacttttatgagaaaacctctaatatgataacattatttgtttagtacgtcagtttggtaaaattaaaagaaaagaaaactataa

SEQ ID NO: 400211 - DNA, 453 bp, Homo sapiens
ggcaagaagaaacaatttgacttatagtattgttagatatgagctgtaaatttctcttcaaaaaatcagtatgtatgttcaattctttgctttctacttttaaacttaacatccttgtagcacaacgtttttcgattacctgctccaccctgactcattccgattacctgctctgccctgactcattttccaccctgactctttctgatttcctgctctgccataaccatttttccagccaaaccactcacccgtacactatctttaaattagccaattggaattagtttagcctgtgcatctaaccctagccaataggggaacacagcagcagggtccacgtggatcgggaataagaacctcctctcctcccttgtccaggtgtgtgctcactattgctccaaatgtaagggggcacccttctatagaattacattgccttgctgagaatta

SEQ ID NO: 400212 - DNA, 437 bp, Homo sapiens
tttcatcattattttccatgttcctaagtggccttaacatacattcgttagaggactaacaccaagttaaattgaacataaaacattcatctccaatatattgttttaagctgaaaataaggattgttgaagtttttccgttatattttgtggtgtaggtctaatgaccaaattaaaattttaatattccaaaatatgattaggacctgagcctttgccttctgtatttaatgtctggaattttttatagtctgtgtgggtatggctagttcctgcaacaacgtggcacttgcttctcacatgggagtttcccctgtaatttcctgacttaccactctatcatgttgcatctctgcttataactatctgtttcgctgtttttccttcaggctacatacatagtgccttgtacttgcttttaaatgtactcagattct

SEQ ID NO: 400213 - DNA, 416 bp, Homo sapiens
tcttgataaaatataaaatctagttttttagacaaatcaccaaaatggtaaagaaaaatcttctgcagtatgctcattatttctttttcccatttagagctttccattaaaaaaattaccaatcatctgaaagttgattgagtacttgaatttaatcagacacaggaagaatgtgtccagggttattgagtgtacactgtgttatagaaaaatatgaacaagaagaggactatcttgagcagggaaatacatggctctcagtaacagcatgagaaatttcctggttacatgaaataatacagacataccaagaagagccaagaatacagattcaaattatactgaaagaaaacttcgtttttctaggcctttaagataaacgtttctgcatcaggccataacaaagttcaaactga

SEQ ID NO: 400214 - DNA, 649 bp, Homo sapiens
gctgattctcttatggattttagtgtcaacaaggtcatcagaaattatgatcaagacctagtaacaagttgagaaataagtttgtgtgtgacttctgagtattgctaacagatatattttttaaaattccaattcattttgtgagcttgcaatctgcaattggtgttgaagaagccattttatggagcattttatcatctggataccagatgttctggagtatatgctttttttttttttaaatgacccattttgtggaattttttttttttttacagtctagggataactcattttcatagtctgcagaaaaactcatgttaggtgcatagtgatttctctctattcaaactattaatgctttgtatcgtatagttttatatattctcattaaatcaattcatatttactgttagaatgaacccatatttactgatagcctactgtgagcaaagcacagtactacaaattgtggagagttatgaatgctgatttcaaaaaaggttataaacatttcttttgatgatgtgataagacagcatgtaaatttgcaatagaaaagttaaggtactgcatgcacaatgctatttaggacaaagtccacccactatagaccgactgtaggatcagtgtcctcccactatttaaa

SEQ ID NO: 400215 - DNA, 392 bp, Homo sapiens
gggcatggtgttgtgcacctgtaatcccagctactcaggagcctgaggcaggaaaatcgcttgaacccgggcggtggaggttgcggtgagccgagatcgtgccacggcactccagcctgggcaacagagggagatgctgtctccaaaaaaacaaacaaacaaaagtgtaaaattgaagcagtgggtatttaattcatggcttaccctcaagacttttgccttctagaaagattttttttttttttaaagacagagtctccttgtgtcacccaggcccatagcttatagaagatacgaagttacaactaatgtcggtgtgtgtcatgagattcttttttttttttcaagaatagttttgggtgttgagcaaagtatgtataaacaattaatgc

SEQ ID NO: 400216 - DNA, 460 bp, Homo sapiens
ccacgtggtcaggagctgtcgatggtgtccggccaacagttagcaagaaagcagagaccccagaccccttataaccacaaacagctgaattctaccatccacttattgaacttgagagactaccataagctacaaatgagatccgtggcatgactaatacctgactgcaccttcgggggaccctgagcagaggatccagctaagccatccagactgctggttggcagaaatgtgagctcatacatgggttttgttttatgccactaactttatggtactttgttactataatgcactttgtttgtatagtgataaataactatacaaaggggaaaaaatctcagcctcataaacagatagttactttgagttccctaaaggggtactattttttgggtgaaagtgacagttccagtgagtaaagatgctccttggcaagatgcatattaaactattttct

SEQ ID NO: 400217 - DNA, 590 bp, Homo sapiens
gggccgtcgcgttttctgggaagccccaggccttttcccgctcctgaagagcctccccgaagcgctgtcgggaagcgctctcctcagggtcctgcgggtcaggcccggtgtttcggtccacgagcaccagcttcttccaccgggccgctaagtctctggcaaagtcgcccacgtgctggtgcttccgcaggcgcttcaccgtctttctgattccagtctccgccaggatgtctgcggtcatgggcaaggcggagagtttctgcaaatatttctctagctttttcggctccgtcttagtggccagacgcacctgcagcttccccactgcgcgcagcgtagtggaccctgccgccatctcgccagagctgtgcaggcgtcgctgtcctcgcggtcgcggctctgtccgagctcggggcggcggcacaggcagtctggggtggccggtcctcgctgcccggtcgccaggcggcgacctcgggatgtggagtcacagcctggagcgagctgggtcctcggagcagcgggccacttggtctggaacgccggtccttgcagacagctgagcaggcccgcttctgttcctcgggatg

SEQ ID NO: 400218 - DNA, 552 bp, Homo sapiens
cccatcacttgtacttggagcagctcaagtgtgggctccttgcagaggctggaaagcccccacaggagcagttgccctgaagttgttacagctgctccctgctgacatcatgtggtctagaagggcccagaaatgggcaccacctcaggcaggttttgactttctgtggttaaagaaagaacaccagttctctcagataaagcagagagagctctcagaagcctgctggtgactgtgagagcaaagtcacttgcacctgaagcaagacagccgagaacaccgagccaccggcagcctggtgggtttggagggtagtgcgtcagaaccagatgtttataaggcttatgtattttatcacctctgctgtacagtttatggtttacaatggctgcaaggaaatcggatcagttttgttttacttgccaaataaaacaaatgtcaaaatagtcaatataaaatgtattctaatttggctgagttaagtcagccaatatgcaacaggataattgaatgttcattaatgcttccaagtaaaagccatttgtctgtcaa

SEQ ID NO: 400219 - DNA, 585 bp, Homo sapiens
gtatttcagtagagaccaggtttcaccatgttggccagactggtctcgaactcctgacctcaagcgatccatccgcttcagcctcccaaagtgctgggattacaggcatgagccaccgcacctggcttgaatcgtttttttgtgttctttagaagtggtgtaaggcaggcatggtggcatgcacccatagtcctagctacttgggaggctgaggtgggaggagcgcttgagcccaggagtttgaggttacagtgagctatgatggcgccactgcactccagcctgggtgacagaatgagaccctgtctcagttaagcagttagtcaatcaatcaaataaatggaagtgttgtaaagttttctttaaataagtttgtacatattcttagtggcaatttctaatatttttttcctttttattgtaaatggggtatgaaaactttaaaatttttaaattaattttgtgctactcatttaagaatcttaatatatattcaaagccgtagcttctgctttgttttgttcagtataccctctttctatcaacaaaactctttcttagaagagctgacaaaaagtatttcga

SEQ ID NO: 400220 - DNA, 464 bp, Homo sapiens
tttcaatcagttttttgactttcaactcagtgttgtgacatcatggtggacacaactttcttagaggtatcaataccatcatcatgtccatgtttgatttgacagacaaatattgcaattttattctgttggacattttccaaagaagttggttactgatttattaaataaatatacatattttagggtagtggaagaagaaggtgaatagaaattaatgggtgagcaaaggtgagggaaaaccaaatcaccagttttctttctgattatattttaatctaaaaggctatgtttttaatcaggttatatgtcttgataagtggcgtttctacttaaaaaatgttggttgtatttgtatcccaagtaggaaatgcaaacatacttgtataaagcaaacaagtttaacttgtgtgtttgtattaatgatatgtgatcaaggcacaggaaatgttagtaaagaatca

SEQ ID NO: 400221 - DNA, 400 bp, Homo sapiens
atttctctatcttatgtgatgtttagaaaggcctttaaaaaattcacaatgaagtccaggcatggtggctcacacccctaatcccagcactttgggaggccaaggtgggtagaccactgacagagtgagaccctgtctcaaaaaaaaaaaaaatgaaattattttaaaataacatttgcagtaggacttatttgtacatgttcaatggaggttaggataatatctgtctaatgtacttgtatacttgaagatatataataattggctggacgtcgtggctcacacctgtaatcccagatctttgggaggctgaggcaggcaggtcatgaggtcaggagttagagaccagcctggccaacatggtgacaccccatctctactaaaaaaaaaaaaaaaaaaa

SEQ ID NO: 400222 - DNA, 479 bp, Homo sapiens
tttttggtgaatatactaagagtatcagccgaggacagaatataaacaatctgctcaagagtgccatttttttctaggaattcaaaagtattactctatctgtgtcccttagaagaaggtgacaagtaactggatgactattttaatagacaatgtgaaccatccagaattgattcctagtcagcaaagacgacagtgctgaatggttctgagagagaagtagcatgcctatttgtgactatagaaaaatagtacagtggaattatcagctttctatcctaggtcataaataaagttacaaagtggaagagacaagggggagaggtgaatgataacaatattttcaagaaagtatagatgataatccttgaactgggcaggtccacttataatatgtgatttttttccaaccaaactcacatagaaaatacagtattcatgggatgtaaaacccaagtacacagaaggctttttgtata

SEQ ID NO: 400223 - DNA, 482 bp, Homo sapiens
agatggagtcttcctctgtcacccaggctggagtgcagtggcatgatctcggctcaccacaatctccacctcccaggttcaagcgattctcctgcctcagcctctgagtagctgggattacatgcacttgccaccatgcccagctaattttttatttttagtagaaatgtgttttcaccatgttggccaggctggtcaagaactcctgacctcaagtgatccacctgcctcggcctcccaaagtgctgggattagaggcatgagccactgcgcccagccaagaaacttttttgaatagttttgggttttcttggagtttctgaatgctattcctctattccttttttttcccccttcatgtgctgttatcattttcttagtttattatttttttctcaagctctcagttacatcttgtattttattacactcctttttttcctggcattttccctccccaaaccacccatctggactggttc

SEQ ID NO: 400224 - DNA, 392 bp, Homo sapiens
agcaggaatagaatcgagagagcacgggaacgggcaggtgatctggattgagatggtttagggctggttagcataattgcttaaggacacctgctcaggaggctggggtttggtcttggcccagtcatttgctactggttgattctgggctagttaagtaattgagtctcagtgttcatgtctctgaagtggaattaaacgagacaacataggaagtgtacttagcctggaggccagcacagaataagtatgtaatggatgttattgctgcagctggcaacagggaatcattgagaagtgcgctggactgtttctttggtaattaacaagatctccctctctgtctctctcctctccttttctctccctttcccttcctccatcttctccct

SEQ ID NO: 400225 - DNA, 471 bp, Homo sapiens
cttcacttggtcctgccaaagatttccagcagagggcatctgagatattgacaccctcacttacagcaggaggagaaggcctggggcagctgaagtccctgggccagttacctgtggctgtgaacagcttcatctgagaatctaaatcctttccagtgtgttgcacaaagttcgttttctcttttggccttaaaaagaaaaacgttgggaagtgctggcctagagcaaacttttcaagaaaacagaggctatggttacaatatagcacccttcttaagccatttcattaatcactactttttttagttcatgctgaatcttagcttagaatcaagaatgttctgggcacattgaaaaacttcacactaacttgactccagaaggcaatacagtctcccaacttgaacctcaggagcactttctgcagctgcctaattctgaatatatatatatatatatcttttccccata

SEQ ID NO: 400226 - DNA, 425 bp, Homo sapiens
gcaaggaataaaaacaagacaggcatcaagtctggtacagcttcatttatttcttactcttcctaccgaattgagtttgcatccaggtactcctcatgcctccgttggcagaatgatgatgtaatgaacgaacagcatttacagtaaatgacagcaaattgctctgtaattcaagggctaacccatgtgccacacaatgatcttttgatgtctgtgaatttcttcaaggtgggtggggaagctttttgcttgtagggaaggctctggatggactgagcctctgacatatcaactgtaaatcctggagtcctggggctttattcggaggaagaaagcaccttctacaggcagcagtagagtggactgtcccagaatcgagcccactgccctgagaattggactccacaatggccagttggacattg

SEQ ID NO: 400227 - DNA, 480 bp, Homo sapiens
ctgtatctctagaacagaatattccctggagcatcaggcaggtttatcaaacccagaggagatccacattcaattcgttatgtccagagccaatgagctcattccccaagaccaggtcttcctgtgctccctcttgtatgatgaagggcatcacagactccactttgcccaagcgccaacctgagcatcatcctgaaccacactctcctgcatctagtccatttacaaatcttaccagttgtacctcttgtttgcttcttgctaagtcaagtgccccaaagatgaagggctatcaagggccaccagtaccaactccagaggggaggatgaagcccactctctttctatgcttgacgtttagcatggtgcagtgaaatacacatcaaatcaggaaccatccacaaaacagggatttgaggtaataaggtggtattgcttgaatttttgtcccttttgaaactcatattaaaacttaatccc

SEQ ID NO: 400228 - DNA, 143 bp, Homo sapiens
ttttattttttaaagagattaagtctcgctacattgccaggctagatttaagctcctgggctcaagagatcctcctgtagcagcttcctgataggtgcacatcactgtgcccagcttcaataaattatttctcttacagtttc

SEQ ID NO: 400229 - DNA, 302 bp, Homo sapiens
catactgtcttcctctaagaatcccttcccatgggcaagcccagcccccagtctgagacggccccacccagctagccatgctggtgtgcaactatccactcccttggtgaagacccagcccaccaaaccagagtcctcgcctcactttcaaactacagaactccaggctgttagagcctcgcagagcagaggatgcctgcgtgaatcccagtctcaacaccagctttgttggggtgggagtggtggtggcggcgtctgtcatcagtggttggccttttaatgtggacttgaggtgaaaaact

SEQ ID NO: 400230 - DNA, 418 bp, Homo sapiens
cctggggccttgtcaccagtcatactgcctgccagtcaccatctttagcatgtgtatgtacttgagtggataagataggcttttatttcttttatgatttgcctcaggacaaatcaaagagagcttcactaataacttgtaatgttactcggaaaagagaccagggcttctagcccatgtaaagaagtagaactctggccttgggataggtaaggtaggaggctacagtgggagagagtttaagcagagtgacatcagccattttactgtatgcatagctgggaggcagatcaaggacttcaaacttcaagagtaatggaacttgctgtccaaagcacctgctgaacaacagtttcaaaaacaaggcgtgcctattgcagggttcctaggtgctaaaacttccacttattttataatg

SEQ ID NO: 400231 - DNA, 148 bp, Homo sapiens
cacaagcgtggccagatgaaagttcatgggaatgcaagcagagggcctgattccaatttttacttcttctgttactagttgtgggaaactgatataattcctttgaggcttgttttctttatctgtaaataaagacaataatataata

SEQ ID NO: 400232 - DNA, 336 bp, Homo sapiens
caggtttacgtaagaggctcatcaagaaggaaaggaaaaaatggttgcaacttaagtgattttccccttccacttagtcctccgttcatagggcccaatagcttcctatcaagcatctcaaaatctttctgacacctggatttcaagattttccattacttaatgcatcctcttgaaagtatccccacacttttccactacccatcagcgggatgccattcagtaatggaagctacattccatgagagcaagaacctcatctgtatctctgtgcctgaaggagcctgacacatagtatttaataagtactcaataaaaatctgctttatgaaaata

SEQ ID NO: 400233 - DNA, 624 bp, Homo sapiens
tttcaaagaaaactttcataccaaagcaagctaaggggaacaaaaccatcacatttctagaaaaaaaaaaattaccttaaaacccacttcctcagttagcaaatatagtgtggagaagaataattacataatttcactcaaaaactaatctttgatataaaacatgtaaacaggaatggattattaatcatagacacacctgaccgagtagggtgaatgctgagtttgctaaacattaggcagccaaaaccaattaaacatttagttggtagagtcatatcatgaaaataaattacagatatgaagtcttctgctataatgcttgttttgaaaatgtgatttgattcaacatgattgaaatactagagaactgcatatacagcaaatttcacatttgcttatgtacaatttaatccacagaatactactaggtaaacagagataattgcattgagctgtttaaacgatatattctattccttcctattacctgatctcagtgcaaaaaacatttattttactaattttctcaacttttgaactttcactactaatcatatgtaatttccttttgcagttcttttggtcatccataactatggtaattcttcaagttcttatgct

SEQ ID NO: 400234 - DNA, 501 bp, Homo sapiens
tgatggagtctgactctgtgaaagaagaaagaagatgatgatgatgacacagacactcagaggaaaatgcaatatggagatgtcggcagagattagagtaagacaactacaatctaaggaaaacaggattgcaggcagccaccaagagctggaaaaagtgaaaaatagattatcctgtagagccccttgagggagtacagtcctgccaacactttgatttcagacttctggtttcccaggctaaatgaagatactcctctatgccattcaccactgtgttaaatccttgcaaggaatcttccaacaggtggtgtcagacaaacacaggtgcacatacactaagacatccaaggtatctacaaatacctacacagcagggactgggagatggaaggtgtgttaagtgtgttgggtgtggtattactcaagtctcaccactacagagaatcagttttccagaatttctcaagcaaattttattattaattgagcaggaaagga

SEQ ID NO: 400235 - DNA, 465 bp, Homo sapiens
agacccaaatccacgaattctgttcaatgagggttacctgcaaaatgacaatttagagcaatactaattatttgaaggacctctgttcctatcttttattttagcctgtgtgtgaagtgggtttttggtgtgtttgttttgggaatagactgactagaaatacatcactgtccaaaaggaaaacatttttttcatctagggatttgaggcttaactagctgaaaggaaaatataatttcattttgttctcatagtctcatttagaaaataaccttaagagattcaaaggacatcaggctatgtgagcactttccatgctctgtggggtggggggatttggcttgggcttcaactttatgagtatgttctgaagtgcttcttaagaaagtttttgcctttagctctttcctaaccactagagctttaagaaacttgaaaaaaaaagtcgacgcggccgcgaattta

SEQ ID NO: 400236 - DNA, 404 bp, Homo sapiens
aagaaaaaaggaaggtgttggcaaggatgtggagaaattgaaacccttgtgcactgtgtgtggaaatgtacaatggtgaagctgctgggaaaacagtatggcagttcctcaaaaactagaaataccatgtgatccaataatttcacttgtgggtatatacataaaagagttaaaagcagacttgaagcaatatttgtacacccatattcatagctgcattattcacaatagccaaaaagtcaaaacaactcaagttattcatccaaaatgctgggattacaggcatgagcccccactcctgacccccttgggagtttttaagttctccaagtacaaataagtccccattaatagtcattttttttggatcttcacacccattgggatggctgctacccagaaaa

SEQ ID NO: 400237 - DNA, 924 bp, Homo sapiens
gtccagatgatccctcaagcaatcagtattttgcccattcctgttatcagaatctgtggagctcagatgtaatctgcaattgtcttcaaggttatacgggtactcagtgtggagaatgctctactggtttctatggaaatccaagaatttcaggagcaccttgccaaccatgtgcctgcaacaacggaacatagatgtaaccgatccagagtcctgcagccgggtaacaggggagtgccttcgatgtttgcacaacactcagggcgcaaactgccagctctgcaaaccaggtcactatggatcagccctcaatcagacctgcagaagatgctcctgccatgcttccggcgtgagtcccatggagtgtccccctggtgggggagcttgcctctgtgaccctgtcactggtgcatgtccttgtctgccgaatgtcacaggcctggcctgtgaccgttgtgctgatggatactggaatctggtccctggcagaggatgtcagtcatgtgactgtgaccctaggacctctcaaagtagccactgtgaccaggcaagatactttaaagcttactagtgcactcaaagtgagcatgatagtgagacatggtttctaaatgtgtaaagaaagtttcttttatgtactgttgttaattagtgcattgaaacaggattggccttacaggggatggagtcagcctctatcaaggaatgaaaaccaaaaaaagagaatgagcatctcaaagttcagcttcgcctacttcagttttctctctgtgactgaggaagtcagaattcatacacagtgaaacacagacatcagcctcacctttcactatttcatacatgtaaccatagggaagacctaagaaatagttaatcagaagagattatgaatcagaatgaaaataaacagataccttcaaaacc

SEQ ID NO: 400238 - DNA, 1025 bp, Homo sapiens
gtccagatgatccctcaagcaatcagtattttgcccattcctgttatcagaatctgtggagctcagatgtaatctgcaattgtcttcaaggttatacgggtactcagtgtggagaatgctctactggtttctatggaaatccaagaatttcaggagcaccttgccaaccatgtgcctgcaacaacggaacatagatgtaaccgatccagagtcctgcagccgggtaacaggggagtgccttcgatgtttgcacaacactcagggcgcaaactgccagctctgcaaaccaggtcactatggatcagccctcaatcagacctgcagaagatgctcctgccatgcttccggcgtgagtcccatggagtgtccccctggtgggggagcttgcctctgtgaccctgtcactggtgcatgtccttgtctgccgaatgtcacaggcctggcctgtgaccgttgtgctgatggatactggaatctggtccctggcagaggatgtcagtcatgtgactgtgaccctaggacctctcaaagtagccactgtgaccagcttacaggccagtgtccgtgtaaattaggttacggcgggaaacgttgcagtgagtgccaggaaaattattatggtgatccacctgggcgatgcattccatgtgattgtaacagggcaggtacccagaagcccatctgtgatccagacacaggcatgtgccgctgccgggagggtgtcagcggccagagatgtgatcgctgtgcccggggacacagccaggaattccctacttgtcttcaatgtcacttgtgctttgatcagtgggaccacaccatttcttccctctccaaagcggtgcaagggttaatgagactggctgctaacatggaagataaaagagagaccctgcctgtctgtgaggcagacttcaaagacctcagagggaacgtgtctgaaatagaaaggattttgaaacatcctgttttcccatctgggaaattcttaaaagtcaaggattatcatgactctgttaggtaag

SEQ ID NO: 400239 - DNA, 348 bp, Homo sapiens
ggagtcccaacatctgcatgtatgtctggaatgatctgagcctgtagagttcctacacactggccacattatagggtggtgtctgtggtcacacagctcagggcaggtattagtacatgaatagcttagcggtgtcatagtctttatgtgaaaggctcataaaagcccaaatgcttttgaactggttgcggattttgagttggaggaacacttgggacaaccggtcacattccttcagtgcgcggccactcctcagcacatatcccaaagccggtaaataatgggaagaccctgtactgatgtttgatggtgttatgaacttcaaatgacccctatagaaatgttaaa

SEQ ID NO: 400240 - DNA, 788 bp, Homo sapiens
agcggagcccagcgagggtgcctacaagaggagtcaaagggcaaaggatgaaaaaattgaggctcaaagaagtccaccaaattgagagtgaagtaggggaaacagcatttaacgcttacattctaatgatttgtgtaagagcagcaggacaagctatacaaagaaaaaggtggaattatcaggatggaattaaagatgcttccaaacagaggggatatctcaagccatgactcagaggtaagagtaagagactatgatgtgcacaggagctgtttaaaaagttcactcacctctactcattcatagagacacatttcaaatacgacctcctatcagaagcccccataaattatcaccataacattctctccattcctccttgagggaggtaaaatgtaacaattatcagataaaaagatctttaggaacctaaaactcaaaagatagttcattttaggaatgaaaatgggtctgcagcctgtgtgaacccataaatcatggtattataggaccagtgctcttcctgccaacattttccctaactgccagcttgtgggtgccaagcactctcttgcattataggatttaacacaggacctgacttaatatagcaatgttttcttatcatgtctcatcatttcttctttcttctggatacaccaacgttttgtcctcctttttgtttattctgtggtaaatgggaaaaagcttgaaaaagactcgatggctatcatttcaatacctagaaataaatagttccattcaatttatttcaattgaatagacag

SEQ ID NO: 400241 - DNA, 445 bp, Homo sapiens
ttcacttcaacatacaagttgaccatggcatgctctgggctccagtcctctacaaagatgtagggcaggaactaccagttgtcagcacagcaccatcccacattgctcttctaatggagactttcaccccagatgttctttctcgtctgatgggaaggatccaaatgaaaaaattgaggctcaaagaagtccaccaaattgagagtgaagtaggggaaacagcatttaacgcttacattctaatgatttgtgtaagagcagcaggacaagctatacaaagaaaaaggtggaattatcaggatggaattaaagatgcttccaaacagaggggatatctcaagccatgactcagagagatccaatcgagtaccaggtccagcggtaatctattcgcagatgtagtggaacatctcagaagaataaaaaagaaaataacctaaacaaa

SEQ ID NO: 400242 - DNA, 392 bp, Homo sapiens
agagaatggagatcttcagtgaccaaataatcgagtagtaatctgaaataagaataataaataaagccagaagctctggctgacctggaagcaaatgctgattccagaaaacaggggctctggacgttaacatttgtgaaaagccaacccttaggccccaacaaagccaaatgcccaaagaggccataacttctgggagaaagggtgttctatggatcgtaagcctgctagttaaagaatctaactaggaaatctgtctgtctatgctggttacaggttgagaaataaagtatattagtttctcctgaatctttacaatagtagctctgaatttatgggcatagagttcaaatttaaattactcatccaattgggaagatactcaaccaata

SEQ ID NO: 400243 - DNA, 1892 bp, Homo sapiens
  misc_feature (800)..(800): n is a, c, g, or t
  misc_feature (1169)..(1169): n is a, c, g, or t
  misc_feature (1886)..(1886): n is a, c, g, or t
  misc_feature (1888)..(1888): n is a, c, g, or t
  misc_feature (1890)..(1892): n is a, c, g, or t
gttttttccctacctttaaacttccctgttacttctgtgtagtttattcctaaatgtagctagccttggcatcagaagttttagtttcttgtctccagatacttgctagacattttcacttagctttttagttttcatttcaataatgaaattcctcatatttatcttttccccagaccacacaaaacattgacttttctccttggttttttattttgttaatagtggtatcatttccacctaattttcccaatatctaaaccctgatttctttactactctcccttcccttacctacctgtacccgagatgtacttagtcaccacataatgctgattttgtatttttccaatattttactatgacaatattcaaacattcatccaagttgaattttaaaatgaagtcatatctatcacttagattctatcattaacatttatactttatcacatatctatccatcttcccctccatccatctctattaatccatcttctttttgatacattaagtaaattgtagacatttgtacacttccccataaaaacttcaggatacatatcattaagtagttttttccttttgatgtgcagtttacatataatgaaatgtacaaaacttaaatgcacattagcttacttttaacatatgcatgcatgcacttgtgtaacccaaatccctatcaaagtataaagtattaacattgtcccacaaatttccctcatgctccttcccagtttttcccgtgctctccctagaggcaaccactgtttggacttttttctaccatagattanttttacctgttttagaattttatagaaatgtaatcatatagtatataatctttatggaaagcttcttaaacttggcataatttgagatttgtctgttgttgcatgtgtcagtagtccatttgttttcatggccgagtagcatttcattgtatgactgttccacagtttgtccattctcctgttggtgatagatagctggactgtttccagtttggggctgttacaaaaaaagctgctaacaaaaaaagctgctatgaacattcttgtagaagtctttgtaaacagatgtttttatttcccttgggcaaatacctagcagtggaattgctgggtcatagagagatatgtgtttacttttataagtaactnccaaacatttttccaaagttgtaccattttacacttccaccagcagcgtatgagaattccagtagtttctcttgctcaccaacgtttattgtcgccacactccttaactttatccattctggtgactgatcatgttgtaaaaaaatctattttatagagcagttttctgtttcttgccaaattgagaggaaggcatagggatttcccattttccaccggcccccacatgtccgtagccttccatattatcagtgtcccccaccataccagagtgtggaatatttgatacaatgatgaacctaccttggcacatcattatcatccagaggccatagtttatattagtgttcattcttgctcttgcactttcatgagtttggaaaaatgaatgatgacatgtatccttaattatagcatcacatggatgctataatggagcatttctaccccagaaatctgtgctctgcctattattattcatcccccaactcctgtcaatcactgattttttactgtctccatagttttgacttttccagaatggcatataggtgcagtcatgcaatatatagccttttcagaatggctcttagcaatatatatttaagtttcctcaccaaatcattatctgaatgtaccacagtttatagatccattcacctactgaataacatcttggttgctcccactttggttacagttgccctaaactccatntncnnn

SEQ ID NO: 400244 - DNA, 993 bp, Homo sapiens
tcactcatctttatagcatagctcaattgtcacttcatgaagccttccataacctttgtagctccattaattatattcttctgagtgtttaaaacacttgccatatgaaacactatttactttggcttacattcttactatctaatcggccatttctgttactaaatctttttctcagagcacctgggatagtcttgtgtcttagtaaaatcagttgattgatttaactcggtagagtagaggctgattaaagtaaataaatctggttgatgccaacaaaattttggtcccctcaattttttgctctcattacctgcaaattctccctggccttcatatttggcaaccattgaggagaacaaggctgtaaaagtagttcatgtacttgatattctgaattggaattaagcagagttgcttaagtaggacttgcttttctgggatttcttatgcaacaaataatgtagtaactggaaatccaagttcaagacactggcagattcgatgtcttttgaggacccttggcttcatagatgatgccttctccctatatccttacatagcaaaaggggccaggcagctctggcctttttttgtaaggccaataactccagaaacctcatgacctcatcacctcccaaaggccccacctctcaatactatcacattgtgaggctaggtttcaacatatgaattgtgggagacaaaaattcagaccatagtataatatttcaagattacttaaactcttctctaccaaactcattaacttttaggttagcacagtattttcattgatattttggtttctggagttattactaattttcttgatctgatgttataattaaaaaaaaacaggactttgtacgtgaaatgagactgagataaggaagctgattcagagatggagatttaaaaaaagagagatgagagattgagatctgcagtgtcaaactgacaatagccaggagtcaggagatattaagagac

SEQ ID NO: 400245 - DNA, 462 bp, Homo sapiens
ttttattgaacctttaaaatggtaatggtttatgtaaaaacttctttatgttaaatttgtcacacattgagtaagaagagcaagttacaaaatagtatagataatacactttcccccaagctggacccatcttaaataataataataaagagaaaaccccaacctacgtgtgcatgtgtatgcatagaagaaggtagggatatacagcaaacgctttaatagtgcttacttctggcaagggacttatgttttatctttgtttttttaccttatatacctttgtgattttatttttttaagattatggacttaagtaatttttttaaaaactgataaaattttagatagagtattataaaactatgccttctcagaaatatgtaaaaatcatgtatttgttttgtattactttggctctttgtaatgttcttcttaaagagtaaaatcttttctgtttcaagg

SEQ ID NO: 400246 - DNA, 189 bp, Homo sapiens
ggcagcatatggttaaatcctgttttgtttatacattcagccactctttgttttgattaaataatttaatctatttacattaaatctaatgattggtaaataaggacttactattgccattttgttaattgttttctagttattttagagatcttttttctttcttcctctcttgtttctttcttcctc

SEQ ID NO: 400247 - DNA, 2250 bp, Homo sapiens
  misc_feature (370)..(370): n is a, c, g, or t
  misc_feature (2016)..(2016): n is a, c, g, or t
ctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtcncttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcangcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaa

SEQ ID NO: 400248 - DNA, 542 bp, Homo sapiens
ctgggggctcccggcttttctctgtctgcagtgtccatgctcgcatctcagcctgccggattcctaccctcctgccaagactagcacaaatgcagtctcctcgctgaaatctctgtggttcctgccacctgtaacccctcctttagcatttcgtcacctgtagagcgtttgtcactgttcatctggtattaaagattccacattctcatccatttcatctttgcatcccccacgaggctaagtgcagggcttggtactgtgtagatactgcttatgaatgtgtcttgtcttgtcctttttgtctgtttccatcatctgaggatccttcctctggggggttgacatgccttatttctaaaatggccgaccggatgcagggcagagccagattgcaccaggaccctgccatcgatatagtccccctcacccacccccggtgttttgaggattaaataaattaatgaattaaacgagttagtagttataaagtgttagcacctattaagcattataaaaataaatttgaaaatgaccagcaaaaa

SEQ ID NO: 400249 - DNA, 827 bp, Homo sapiens
agatcccccatacagagtagaaattaatggtgaatggcatgaggtaacttttggaggcagatggaaacattctaaaacagagttgtggtgatggttgcacaactctatgtatttgctaaaataactaaattttccagttacaatgggtgaattttaggatatgtaaattatgcctcagttaactctaaaaaagaaaagcctgtgactcgaaaagttaaggaaaaaataaaatctagggatagggctgaaagttatactcagaatgaatacgtggctttaaattcttttattattaaaaagcaaactaaaaataagtcaactctctattcaacttaataaatgaagaaaaggttaaaataaaagacataggataattaaagataaaagtacagatgaataatactgaacacaaacagaacagtcaaaagaataaatgaacttataaggagacataaccgccactgataaggaagagattaaaaggtgcattaaacaatgaccatgtactagttaacagacccccctttctaaatggacgcactgtgctaagaagctacagacgtttcatagagaaaagcaacaggcccactgagttccaagtcaacctttcaaccctatttcatggacacattccacattttattgtttctgaaatccgggtccatctcattatccctgtcataaggtggcagtgtgagggagctgcgggaaaagctgctgcaggccaccccaggaaccttcacaaagtgctggtgacaacgaatcttttaaggatggtagtttttgaagttctctattattgcttgcactaaaccttgaagaatttt

SEQ ID NO: 400250 - DNA, 334 bp, Homo sapiens
acctggaaatattgttgctaaaaatatactgcctggcttccccctcagtttctggttccctctatcttgggtggggtcaataaatacataatgctcaaacatttcttgggtggttcagatgccttttgtgagccctcttgaggcataacacaccttgttgcctttaggcttttgtacttactgtgtctggtatgtgtaccccttttactaagaataaggtgcctctgactttcccattctggatttggtactgtaggaagtcaccaccactgcagcagatcagtgtcaaattatctaaaatgtaggaagaaaaggagcacatttcaattctggc

SEQ ID NO: 400251 - DNA, 472 bp, Homo sapiens
cctttgagtcaggtctgggacagaaagtaagaacagcccagaaatcctaacagcacaaaacagaggaggggtttcacccagtgagaagttctaggtacatgagcaggactcttctcacactgacagctaattcaggatttttatgcttggtacaatggcagaaacactttttaaaaatctttttgtaggccgggtgcggtggctcacgcctgtaatcccagcactttgggaggccaaggcgggcggatcacgaggtcaggagatcgagaccatcctggctaacacggtgaaaccctgcctctactaaaaacacaaaaaattagccgggcgtggtggcgggtgcctgtagtcccagctactcgggaggctgaggcaggagaatggcgtgaacctgggaggcagaggttgcagtgagctgagatcacaccactgcactccagcctaggcgacagtgtgagactccgtctcaaaa

SEQ ID NO: 400252 - DNA, 385 bp, Homo sapiens
cttcatctaatttctcttttgcactgctagagttttgccttattgaaccccttggtgggagcagggccagtcaatcttccagtgccaggggttgtaactgatgctctcgcatttttggcaggggactggcaggggcttaatatagtcctttatccaattctcgtttttcttgcatttgaagcaagagtctttgttgtgcagattatcagaggcaagccaaatcaaccaaattccaagtggctggtgtgctccatcaattcctgcaggcctgaaataggtagcctaggaattccaaataaatagaacacatgatgacttgttggaaattcgcaggaaacaaaataactattctcagaaccaaataaaagccttccactagaaacta

SEQ ID NO: 400253 - DNA, 377 bp, Homo sapiens
aggctattatcataatcaaagacatgatcctgagttccagtgagtttccagtgaagggcaccggaaaaggttacaaagaaaaacaacttttggccgggcgtagtggctcacacctataatcccagcactttgggaggctgaggtgggcggatcacaaggtcaggaaatcaagaccatcctggctaacacggtgaaaccctgtctgtactaaaaatataaaaaattagccgggcatggtggtgggctctggtagtcccagctactctggaggctgaggcaggagaatcacttgaaccagggagacggacattgcagtgaaccgagatcatgccactgtactccagcctgggcgatggagcgagactctgtctcacaaa

SEQ ID NO: 400254 - DNA, 405 bp, Homo sapiens
cctggctaattttgtatttttagtagagatggggtttctccacgttggtcaggctggtctcgagtgtgtctattttttaaatacacaaatatcactggaagaaatagtattataatataggctgcctgtgagaaatagaactgagaagctgggagataggggaggatggagatttttccctctttatacttttgggcattttgaaatatgaacaacatgaaagtaagagtattctgaaaatgtcaagaaaatgagaggatttatacctcgagctaaaatagagggacagggacaggacttaacctcccacctaaacaaccaaaaataaccaactaaataaaacaactgtttaagacttcagacatcaggcaatgaaggacagtggtgcctgagtgataagggaca

SEQ ID NO: 400255 - DNA, 271 bp, Homo sapiens
atggtgagtagcagctataatttgagagagggtgtgcgtctagttcatgtccagaccccaatgttagagtctgatagctccaacaatgatctggatttaagattggatttaacaggaacctatgtgtaaaagatagataggctcatgacccatatttctagatatcctgcctgaccttatttcccataaagtttgtttgctaatcctgcagttattaatcttggttgtggatcagaatcactgggagaacctttgaaaatgtagattacca

SEQ ID NO: 400256 - DNA, 553 bp, Homo sapiens
tgaataacccactgcttccagactagatggctttctgtgtgaccccaagagagactcccagcctctgctgattcctatgtaaagtatgggttggaactggatggtatcgtaggttcctttagctccgtatgattctcatgtaaaattccacccagcagtcaggcaagaggtgcactggggagaggaggtggaacccccaggttgttgataaaatcctgaaatcccttggctctgtgcttcaaacagccaccttcccaacatctatgactctttgaactgctcataaagagcgctgattaatgtgacacttcacatgcccaccatgaaattaggaaggcccttagatctccttcaaacccgcggtgccggtgccttcgccccatcaatcagagatgaaactgtgattgtgctgcaaggagacgaggccatcctggagttctgccatgaaagaatcgctgggactcaaaggaggggaaaacaagggaaggagagagggggaaagggaaagagaagctgcttccagaaggaataaatttgtgtgtgtactttgatc

SEQ ID NO: 400257 - DNA, 374 bp, Homo sapiens
aacctcaccttcctcttcttcggggtcacctgggcctggtggacaggtgtcccaggtgttctaaagacctgctgctgagcagcgagtcacctgtttgttcgtcttatctgatgtcatctgagcatcgggtctgctgttttaagcccccaccccagctccctatttgacagccttccctcaggggaggggcaggggaggaccttggctcccagctgttcagggtgggcgacacccccctattatcttgcccggaccccaagttcttttgttgtcgtcttttgggcttcgggacccctgtgtgagtctctgatgcaccccatccatcctcctgggcctagacccccctggcctggagccacctcacacctggctcc

SEQ ID NO: 400258 - DNA, 470 bp, Homo sapiens
gatatcaaatagtgaagggcatgatcccttcatggagctttaggcaggtaagatataccgcatggaaaataatttatacataatataataatcctatgaagtaagtattatgctttcttaaaacaaatgaggaaaacacattcaaaaatgttaattgctgcatgtgttatagtgaaatgattgttcagccgggcgtggtggctcacaactgtaatcccagcactttgggagaccgaggtgggtggatcacctgaggtcagaagttcaagactagcctggtcaacatggtgaaaccccatctctactaaatatacaaaaaaattagccaggcatggtggcgggtgcctataatcccagctacttggggggctgaggcaggagaatcgcttgaacccaggaggcggaggttgcagtgagccgagattgcaccactgccctccagcctgggcaacaagagtgaaactttgtcc

SEQ ID NO: 400259 - DNA, 335 bp, Homo sapiens
gagaatttgagtggaagacagaaaagttacagatacagcttcccaaaagtgagtgatacttgagctgattctttaaaaatttgcctgataataagaggaacgaggacagctcagaaagtacaagtcaagaagccctgagaggggagtgaattcaggaaaccggacatttcaggtttgcctcagcattgcatgagtttgaggaacaagaaaagatgaggatggattgtgaatgatctcgaatgtgttttgaaggtttttggaggtatttggattcaccctaagaattggggggaccagtgaaggattttcagccaggagagtgacaaaagcaaatt

SEQ ID NO: 400260 - DNA, 176 bp, Homo sapiens
ccctcctgcctaggagccacacttgtgagtggagcagcctccagataattccagtgcccaatccttcaagttatggggccccagacatgaggagccctcctaactccgccctgagtgcctgatcctcagaacctgtgagcataataaaatgggcctgttctgtgtccctaaatgta

SEQ ID NO: 400261 - DNA, 547 bp, Homo sapiens
tgagctgcaaggctccattagaagagaaatgtggcatgaccctgtgggacaattgctggtccctgccctacattttcttagaggactggagcccactgtgggccatggtcaacttatgagttgaggtaaaggcctcatcctaggagtgcatgtgcttattacacatatgccaccgtgcaaagtacccagagaaaatacatgtaaattgcccatctcgagcgagttgtgctcacttccttttacaaatttgctaaaacactccttcgttttgtactggatattgctaaaacaacatttgggcctgagactcttctccaggtcattcaggtggcagtggcccagccaggctgtgaacccgggctgtgtgattccacagctcacgctctggcctgtgtgcctccttatcgtggagacatggtgttttctcattctttcctgtagccggatggaggttcattgccttgcttctgtccctcggtggagatgggcaatttacttcacacgtttcttctctggtctgcctgcaggctctcgggccagcggccgc

SEQ ID NO: 400262 - DNA, 489 bp, Homo sapiens
ctgcctttaatctctttaattttctcatttatttactgctgcctattttccaaaacactgcttctcgaatattcctggctcaaaaatcatctatgtcttcatgacatatgaaacccctagaatccagcctttccccagcttttaatatctcctaattgatttctcaattccagtgaaatgattccatttatttttttcccaaacacatcacaaatattcctaactcttgtgagcaattttctctcattcttctcaacttatctaaatcctaacttttcaaaagatctagctcaagttctgtcttatcatattttgagttcctttctttggcattgtattattttgtatctttccatgtacacatgtgtgcattatctccctgataaaactaactggctagaggataggagtaaagactcaattctaatatccttgttacctaataatacacaaacgtgaaacatgtttgaataaatcactgttaaataa

SEQ ID NO: 400263 - DNA, 1310 bp, Homo sapiens
attggtgcaaggcaaagtgtgaactttgtcaagggaaggttattttaagggaaaatacaacagagctccagctgaaaatagtcacagggcttcatatatcacttgggctacaaattatgtatcgcatttgtcaacctgccaggctgtttcttgatttcagaggtggctggtgttggctaatactgactgtctcactctgactgcatcttcctcatagaaggacttctatttttgaccctcatcctccacagagaagcctggtaattttcagtcaagtacttggattaagggctttatcgaaaattactaggcctcaaccaaacacaataagacagacaattcagagcatcttcagaaaagaacactggtctgccatgataaaaccaaacagaaggcttttggggcacactcaggcgggcggcaagaatggaatggaaaaagagcaaggagtcattattagctcgggaaggaggaaacgtaaaagaatgaaaatggaaacagatggaaatgacattttgcagagagaaagaaaaagattaagaaaccaagagctaggctgaaagacattcaaaactttaaaaaacggtggaaaggcaaaaacagaagaatgattccgtggggaagaaatacagaaagataacagaacatcattcaaaagcccgtgtccaatataaaacagcagcaaatccattttgccttgctggtttccaagcacaaaggcagagaaactttaatatcacccgattcccgtctctccctgcccccgcccactctcccggggagcacagagagatgccatcgcagggggcctgggatggggacccctgctcccttaacagcctgctcagccttgtccagaggcaagcttgtcctggattctggaagcccctatttcccgtaggaagctgtagacatttcaaacagtgaatgagctctagggtgtatatccttcccacagagtaagtacgtaatgaagatttccttaattgcatatggaaagccagactgacgtcccacctggcttccattttatcatcttgcaagccccggtaatcactggtctccaagcttaactgaggtcttaagtctccttaccccaatacatttgtaaaactggaattgcgttgtttcccctaaaatgaaatacatgtaagatcgaaccaaggaaattcttgtaaacactccaagggctgtgggcacacgctcaggacgtgagcctggtgcacgtggcgctctcagtcaggtcggtaagttctgtggatgctgacggccctccctgcatgcttgtctgcccgttcggtcacttaata

SEQ ID NO: 400264 - DNA, 498 bp, Homo sapiens
tccatctttgtcatccacgttgtcaactggaaggcaaaaaacccttccaaccattgagagaaaataaaaaaggccactggctttcacaaggcaatttcctctgtcggcaaggaaagaaaaagccatttaggtgtggcccagaaccggggaactctttctgtctgggcgtgtgaagctgtgggattccagttctgggataaagtgcatcatcgaaagggtccattcttcagcgactgcccctctttgttctgctcgggcaccccgaggaagccccatgggaagtctctgtgactccacccactgagcggctacagcagagacgtggcatggagagtgtttgccttggccaaggatgaagatatttctccctagggtggtggatcgtgggctttaacttcagaaggacctgatttctagctttccctgtagcactgatgaatcagttaactgttccgagtcttcacgtggccatcttcagaataaagacactgatgacac

SEQ ID NO: 400265 - DNA, 460 bp, Homo sapiens
agacaggcttttcaaatttgaatgtctcgtcacaagggataatattaagctgtttctaaactgttcttaggaatgcaatggataggatgtgtaagattcatctagtgctgttaaatagcttgttatctaataggtgagcatgagttttaaatattttacaaacctaatattttagtaattcattgagggaagatactcctactgcaagagtcatcattgatccacagacgaaatacaggtctacaaacccttaaccacgattctaaattccaaaaaattttgaaaaccaaaatattttttaaaatataacttgttcagtgcctgtattggaactggccttgaacatatgtagaaattcggtaggtagagactaaaaaggtagaaaaacaggcattttaggtagatactacatcttaagacccagatataggaaatgcaaaagtatttatttcggcatctc

SEQ ID NO: 400266 - DNA, 692 bp, Homo sapiens
gtgcaagctataagccttggcagtttctatgtgatattaagcctgaaggtaaacagaatgtaagagctgtggcttagtagcctcctcctagatttcagaggatgtatggaaaagcctggatgttcaggaagaagcctactgcagggaggagccctcatgaataacttctactagggcagtgctaaggaaaatgtggggttggaacccccacacacagtccccactagggcactgcctagtcgagctgtgagaagagttccacagtcctccagaacccagaatggaagatcaaccagcagcttgcactatgaatgtggaaaagccataggaactcaacatcagccctgatatcagccttggtggcttaaatctgcagtcacaggaacagagctgcccaaagccttgggagctcaaccctggtattaatgtgccctggatgtgagacatggagtcaaaagagattattttaaagccttatgatttaataactgccctgctgggttttagattagtatggggcctgtagccccctttttttgtttgatttctctgttttggaatgggagtatctacccaatactcatactcccattgtatcttagaggtaacaaactttttttgtttgtttgttttacaggctcataggtagaaggtacttgccttgtctcatttgagactttggacctgccttt

SEQ ID NO: 400267 - DNA, 334 bp, Homo sapiens
gggcttattcgaagtaacttggccagtcccttaggtataggcccagctcattcacaggttggagtggaggcacatttagcaatggtaggggtgatacagaaaagacagttgtaatgaaggtcttgggacacaccttaatactgtcaccaaatgtccccagggcatcaacttgcactagcatgcccaccatgggtgcacagtcagtgtctcacgaggcatgcctctcctctctagactgcaagctcatgtctggacttggctaaacctctttcttccatgtttcaaagtgttacgttcattttatgtgtgttataaaatattatgaactgataag

SEQ ID NO: 400268 - DNA, 1180 bp, Homo sapiens
cgcagtggctaacgcctgtaatcccagcactttggaaggctgaggtggacagatcacctgaggtcaggagttcgagaccagcctggccaatatggtgaaaccctgtctctacaaaaacacaaaaattagccaggcatgatggcgcatgcctgtaatcctagctactcgggaggctgaggctggagaatcgcttcaacccgggaggcggaggttgcagtgagccgagatcgcgccattgcactccagcctgggtgacagaacaagactccgtctcaaaaaacaaaacaaaaaaaattctcatggaatactctgtatggttttaagaaattccctgaaaacttactatagagtaataatgtaatctaacagcaaacataatgtataataatattacattatatttatagatctaacttaacagatctataaatattagctaatattatgactcttctgttatttggcttctttctattctactttctcagtgcttttatttgtttaattcaggcccttgttttgacactaagtttttgcatttttttttaccttgccaattatgctctttgtataaaacacagttacacaatattgttactgttatcaaaactaataacttttagaactagagcatatcttaaaaatttatcagggcctttatttcacaagttaagaaattccaacaatgaaagtgaaagacagtgcttgccaaaaagcactcctgtggagaattagagaagagaaggaaatggactgcccgggaaaagattctaacacgaaaataacggtagggggcattccaggccctattcagagtaagtttagtgaagagtgagagaccagtggcgtgaagaggaagaaaaggagaaaataacatgtgagaattttggttggggaagctttttcgaattacaaatgtccttaccaaatacaagctgagatcactgacacaaacatattggcagacaagtatttcaaaacctaatgagacgttaaatagcactttagttgtctgatagatcttacaagaaaaataaagatggtcagaagattaaataactataactgatcattgcttttaaaaataagaaatgttccttccgtatatgtaattacccattacaatactacccaagtgttccttctattttctctacaggatattttcaaagaataggga

SEQ ID NO: 400269 - DNA, 353 bp, Homo sapiens
gactagcaatgaacagtgaatctttctgccgcggttattattattattttttaatttataaagaaaagaggctgggcacagtggctcactcctgcaattccagcactttgggaggccgaggcgggcagatcacctgaggtcaggagttcaagaccagcctggccaacatggtgaaacctcgtctctaataaaaatacaaaaattagccaggtgtggtggtgggcacctgtaatcccagctactcgggaggctgaggcaggagaatcacttaagccggggaggcagaggtagcagtgagctgagattgcaccgctgcactccaacctgggtgacagagtgagactccgtttcaa

SEQ ID NO: 400270 - DNA, 861 bp, Homo sapiens
caccccacacccctagcccagggtctcttcatcgatagggggtgatctgtctgcccctcactgttttctccaaatagatcaaaacctaaaaaggtgggaatgaaagaagctcctaaccctcctggcttttttcccaaagccaggaggcagctcctgaatggtggattttggactactggtgaggctgtcagcaaagggcctggcccagagagatgctcaagagtaggatgaaaagaccgtgggcttcttcctctgcaaaaggaaaggtttgggactgatggatgctgaaaagtctagatcttcataatcctcaacagcttcactgccactgcacacacaaaatgagtgtgccctatatttccagccctctgatgaatacgaaaagagcctgaagaactcatcttcctggtcgcaaagtactttaaaatatataatccctcaatcttaaacatacacattttattgctttttattatacaataatacatatttactattgaaaatacagataagaaaaaagaaaatggttcataataatactacccaggtttaaaaaatactattcagccttatgttgaagaatctgactcttttcctatgcaagcatgtatttcaagcaaaactggacacttcatgtgtaccttgttttgtgatctttttttcccaaattaatatataatcaatatctttttgtatcaatcttcaatcctttcttctgtcacttatttttaatggttaacagtcatctactatatagatattctgtaatttattaaagtgatccctcattcttgaaaacataacctccccaacgcatgcatgccaattcctcaccccccgccccccacttttcgaccaccc

SEQ ID NO: 400271 - DNA, 806 bp, Homo sapiens
caccccacacccctagcccagggtctcttcatcgatagggggtgatctgtctgcccctcactgttttctccaaatagagataagatctcactatattgccctggctggtctcaaactcccgtgttcaagtcatctgcctgcctcgacctcctaaagggcaagcgggattacagccttctccacagcccagccacagtgagggagtcatcagcactggaacccggggtccacggccttggaggatccggaccctccgcatttgaggaacttggccttcagtcagggagccaagaagtccctgccaatcaaggagggggtgtgggctggtggggggggggcagccttggggcacgggagctgatagaccagactcaagagttctactcctgacttctagattgttccacctccatatggaatatgttccttccatctaacactgtgtgatttggggaccatccaactcaaatgaaagaagccaagccatgcagcgagccaccccctccccaatgtggggtaccccctgcccccgcccagctcccctgccctcccagctgaggggggatcgccgcctggtgatctcagcctcccctccaagtgggctgtgaagtgtctaatccaggctttcatctggcatccacaattataatgtcaagattgaataatctgcctttatctcccgggtgacagccatgtagaaacttcaaaagaaacagttttgctggcatctaacggcttttgttaattactatatcccaaagaaaatgaaataaaggagggagaaaaatgatatttctctgtgacaa

SEQ ID NO: 400272 - DNA, 517 bp, Homo sapiens
agtcttccatttagctttagaataaccgtatgaaagagctactttttgtttttgcaaaccagtttttaacaccaattagtttgaaggcaggtttgctgtgtgacatttttgtaccacagaatcaaattaggcagttaagattcaggtttctttaaaccaagttagtaactaatctcacaggtttaatacattttttcccacaaaatacataatttgtatggattttgtgaaccatacaatagaacctaaatttattcaatgtagattgaagttttggttttgtaaaatgtatccactgtgtctaatcagaaaaaaaagtttacttttgcttctgtatcagacaactaagtgatttatttaccaaagctaattagagcagtagctggtgaaaatgggtacttagaagacattgttgtcgttaaaagttacttttctttaagcagcggttttacttgtgtatcatttgcttatcttgttacatgtttgttcttcatttttaaaagtatctttggaagca

SEQ ID NO: 400273 - DNA, 498 bp, Homo sapiens
ttttcctctcctatatttaggcactataagcatttctgctgtatacctgtcttcagggtttatgactaaggcatataaatctattctcatccaacctggatatatcaagattgttgttttctgactgaaaattacaattttaattctgtatttgtcttccttcccttatcatagccataagaaaatatttagacttaaaaattcctatgcgaggccgtgcgcagtcactgacacctgtaatcccagcactttggcaggctgaggcaggcagatcacctgaggtcaggagttcgagaccagcctggccaacatgataaaaccctgtctctactaaaaatacaaaaattaaccaggcatggtggcgtgcgcctgtagtcctagctactcaggaggctgaggcagagaattgcttgaacctagtaggcggaggttgcagtgagccgagatggcaccactgctctccagcctgggcaacagagtgagaccctgtctcaaaaa

SEQ ID NO: 400274 - DNA, 824 bp, Homo sapiens
acggtggaggtggcgccaaggcccagcagtggagctggagataactggatggcttggagatggggtttggaaatagagtcattcagaactggtgatggattgagtgtgggctgggagagacagggagacattgagaataactcccaggtttctggcttaagtcattacatggcatgtgatgccattttctgtgtacttttgtagtgaatacgaattacttgttcaattaaaaaagtaaaataagtttggatttgcagatgaagaaggctttggtgaccaaacaaacaaaaccaaagcagttgcagtgaaagtgaagaggtggagatagttgctacagactactgcagttctgcatcttcaaagaagccagaaagtagcaggcaaggtagggtcgggctgtaggacaaggacatgtgttttgtttacagagtaggatagatgtgagcaactttcattgggagagagagctagaccatagagggaagagaaggcattcgttaactcaacaaatatttgaatgtctgtatgacaggcaatactctaagctcttggaacatacaaaacataaaaaacattcctgtcttctggagcttaatgttctaaagtggggacactgaaaatcaaatcatgtgccgagtgcactgtaaaaagaaaaaaaaagcctattaatggggagatctagggatgttgaggtgggacggccagaaggatgtaattttatgttgtgggtggcactgatggatttgatgccactagaatgcaagatatgccagggcagagattttagttttactcactgctgcatctccagtttagaatggtgc

SEQ ID NO: 400275 - DNA, 780 bp, Homo sapiens
attttatggatgccatttctgcaggctactggtactaggagaacttaacaaacggtgccaggaatgtttgctgcgtttgctcagctattcaggttgatttcctggggtccttgctacaggagattccagtttagaggtgatcctcctgggctgaggtctcttatgaggtctctatccctctaaatctttgttcaaagcttacctctcttaattaggtccacccagacaaccctattcatactcaaacctgctccagaatcccttgtgttactgatcctcctatttctgctgtattgctaaatcagtgaattattttttgttaactacaagtggaatgcaagctctataaggacagaggttttggtattttatttcactgatgtatctaacacagtgcctgaagctccagtaaatgtgtggaataaataaaggaatgggtgcatctttgttaaggcactttatttcactgatatagaaatctcatcttctgaatgggaatgattatttttgttttcaggacctgttacctgcatagtcaaaaatggttcagtgcaagtccagttcatgttgggtgagacccaaggaggtttgctttacatatacaggcatacttttgagatgttgtgggtttgtttccacaccaatgcaataaagtgaatatggtaatgaagcaagtcgcaggaattttttttcccaatacatataaatgtagcctattaagtgtgcaatagcattatgcctaaataatgtacatttcttaattaaaaatactctattgct

SEQ ID NO: 400276 - DNA, 597 bp, Homo sapiens
taaacagatggaattaataggcatatatcttttaaaatttttgctaaatataaatgcagtgagatagcatgtggtctatgtgacaaaaccctgggctataggagtgcagtgggaagaatcaacacttctttgtaatatcagagaaaacctctagttttggaggtgacaatgaagcccttgtcttcttttgattttgtttttctatctacagagtttggaaacactgtaatgctagatgacagtcccatacttcccataggtgcttagtatatgttagtgatcctgtgaacattaaggtagatgaagcattttgaactcaccaggagagtctgttgttataagtgctgagatttgtaatgcttatcccccctgagataaacccaagtaggaaagctatggagatggtttgttgggttttaattccatcttaatttagttgagatactcaaattagtcatttagtctccctttgcttgagtcatttcactagtgggataggattagtagtatttattcgcggcaatttacagcatactgaaatataacaaatcaagttccaaatctcactctacagggatttctctccaagatgaaaat

SEQ ID NO: 400277 - DNA, 2497 bp, Homo sapiens
  misc_feature (972)..(972): n is a, c, g, or t
gcagaccacgttagaacctcggctcctggagtagcagaacctcggcttcaatgggaccctcatttcataaatgaagaaactgagattcaaagaggggaactaccgaaggttacagagcgagttcgtggatggggaaactgagcctcacatgtatgaattccagcatataagcaacagactccagatttggacatgtatatcttattccaggcttcccagatgaccaccaaggtggaagggatgatgatgtccaggcagaagggagctaggccggcccaggcttttcctctaggcacagcggactccaggttcagccttcccggatggtaatgttgcattctgaagagctactttcccgccaactcatctctggacttctctggggcccaactctggtttcctgcctgcaggaggtcccctctgacttccgacagtagatgacccttctgactcacagttctactgctgggaaatgcctccagagctgctgcccaccctctctgcatccctccaggtcactgggtgttgagtcaggggaagcagggatacacacgggcgggaaactcaggtctcctaaatgtcagagcctcaggacttcggctactcagaagtagctccctcctgggccaccagggagcagcagggcagccagcatccagacatcccccctgggttctgctgctcagaggctagatggagaaccaaggtgggaaaaaggcttaaaccacagcgtggggagatttaggttagatgggtcagaggaagtttaggacaagccttgcccttttcagtttctgtccagcttcagcacagccactgcttcctctctttggtttttacccatccccctctctcccatcacctctatccccttccagctttcctttccttccctccttcccaaaccccagagtttctcaggattagctgcccgtgtgcctatctcccccacccccatgctttcctcactgnctcacagaaacaggcaaacacacacacatgcatacaaccatgagctggccctgagagttctctgactggactggggttggagccccagctcttgtcctgagctgaggcccttcccccaggtatcttggggcttccatcatttctcttgacaggagctgtgggcgtctgggcagatgggaacctgggggaggtgtggggagccctctctgaggcaggaagctcccacgctactgtagttaaaataatccggcagcaacttggggcagccatctgggatgcccagatcttccaggacacccagctctcaacaacaaccctataggaacaaatcaaaaacctaagagatacttataggccctggaaatgtctcccaaaagtggcctgaacttgagccctgtttccttttatcttcttcaggttagcactgggcattggcatttgcaaaaaaactctaagcattaagcaaaacttgtaggagtggaagatacagcgttctggacctccagtcctaatacccagccacaccccagcagctatgcatggttccatgggagagcaggcatagcccatcctgctggcatatagtccagccatatcttccaatgcccacctggagactaagccgagttctgcccagcaacaggagctcagagctccagagagcctctcctggggtgcagactcaggagatcttagctcaggagcagacttagcctgacttcctcttttataggaggagacagacttagttacagaggaaaccagagttgttataaatagcaaggaagggagaaacctgctatggattacaaacacgccatcaatcttaaaacaaactatttttagtttcaaataataacgagagtctaattaatgctctgtataacttcaaatgtgggatctttatctgcctttctactttgtgatgctttctaatacagtattagggccaaaggcaggaagagatgtgggcaattctcaatgttaccaaatcctagatatggaaagaacctgagaaatttagtccagccctttcattttcagtgaagaaactcaggcccagagaggtaaaaggacttgtccaaagttgcatagtaaggtagggactgagcagtgactaaaagcctagtccctgtactccagaagcaggacagtttccacagcagcacaatagaacccaaaggctaaacatctgtggttgggcagttggtgagtttatagcctggataaaagtcaggtctaagccaggtgtggaggctcacgcctgtaatcccagcactttgggaggctaaggcaggtgaatcacttgaggccaggagtttgagaccaacctggccaacatggcaaaacctcatctctactaaaaagtacaaaaattagccagatgtgacggcacatgcctgtaatcccagctactcaggaggctgaggcacgagaatcggttgaacccgggaggtggagatttcagtgagccgagatcgcactactgcacttcaacctgggggacaaagcaagactctgtctc

SEQ ID NO: 400278 - DNA, 319 bp, Homo sapiens
gccagagggatctttgtggtgacgggacagttctgtatcttgattgtggtggtggttatacaaatctacgtgtaataaagttttatgtgtgcatagaactatgtacatactcaaacaaatgcatgtaaccctggtgaaatctgaataaggtctgtggattgtgccaataccagtgacctggttttgatactgtattatagctatctaagacattattatcaggagaaaatgggggaaaggtacatgtacttttctgtactatttttgcaacttctcgtgaatctgttactatttcaaaattaaaagtatctgaaaatcc

SEQ ID NO: 400279 - DNA, 400 bp, Homo sapiens
tgggaggatggcttaaacctgggcggtctaaactgccccattgaaacttctctgttttcttacatctgttttcttctctgttttcttacatgcagtgagacgagatcatgcctctgtactccagcctgggtgacagagcaagaccctgtctcaaaaagaaaagaaaataaacagaattgttccactgacaagccagagaacatcacttccccagagattgtgtcccaccaaattacaaaatgcttttgcaaccaccagcacagaacatcccatagaaagcattaaatgacagtgggccagccagatgcggtggtacacacctgtattcccagcactttgggagcctgaggagggaggatcacaaggtcaggagtttgagaccagcctggccagtgtgatg

SEQ ID NO: 400280 - DNA, 629 bp, Homo sapiens
cacaagcctgtaatcccagctactcgggaggctgaggcaggagaattgcttgaacctgggaggtggaggttgcagtgagcccagatctcgccactgtactccagcctgggtgatagagcaagactccatctcgacaaacaacaacaacaacaataacaaaaaaagagtgaaccatatgaggtccagattgaaggctaagaccaacttcacatcaatttctggtctcctggctctcaggccagggctgtttgcaccaggtggattgcgctacttccttaacacctattctgcaggcagataggtacagtcattggctccagcctttcttcctggagggcttcctcctgtccttcaactttgaattccttcccatctttagaatctagtgcaattcccacatagcttcttcatgaagtgtttcccaattattccagctacaagtccttgctctaagttttgctggcattcattttcttcacaaactgtaattgactttctctttatgaaatttaacctttcccatgtctctccaactagacttgtagttccttggggcccagccccagctattgctcaggaccaggcacataagagctactcaataaatatttattgatggatacatttaa

SEQ ID NO: 400281 - DNA, 356 bp, Homo sapiens
caaataagcacatgaaaagatgttcagcatcattaatcatttgggaaatgcaagttaaaatcataatgagatactacttatatatccatcagggagggtatccttaaaaaaaactggtaataccaagtgtttgtgaagatggagagaaactggaatggctatttcttataaaggtaacacctaccttcttataaagaaaggtacacttaccatacgactctgcaatcccacttaaaggtatttatgccagtgaaataaaaacctgtgtccacacaaaatcctgtacacgagagttaaaagtagctttattcataattgccaaaagctggaaacaactcaaatctcaaatgtctttc

SEQ ID NO: 400282 - DNA, 1196 bp, Homo sapiens
ggtgaccgggccgcggcgtgtttcacaagtcgctcgctcgctcatccactcgggcggcggccgggcctcaggcgctgcgacccttttcccgctcctcccaggctgacgcgcccgtctcggcgccgccctcctcggcaccgactgaggcgctggcccgggagcggatcgcggggccgcggtggctgagtcacattcccggagccccgccacccaggacaccgcggccccggcccccagcgagcccggcggacccagcggctctgaacgcggacgcacagccttgttctttcacagccgccctttacctcactcccatggaaaccccaggtgttttcccaagctgggggcttttagtgagttcaagattcaagcctaagtcgtattaaaaattgctggctaggccgggcgcggtggctcacgcctgtaatctcagcgctttgggagcccaaggcaggaggatcacttgagcccaggagttccagaccagcctgagtacatagctgggactacaggcacacgccaccatgcccagctaattttgtatttttagtagagatggggtttcaccatgttggccaggatggtcttgatctgttgacctcgtgattcacctcaggtgatccacctgcatcagcctcccaaagtgctgggattataggcatgagccactgtgccaggccaaaaaaggctttttaaggtatgacatcaaaagcattagtgacaaaagaaaaaaaacagataaattgaacttcatcaaaattaagatactttgtgcttcaaaagatgccattaaaaaaaaaaaagaccacctacagaatgggagaatatgtttgcaaattatatatctgataaatgacttctatctagaatatataaagaatgcttacaacttcatactaagaaagcaaatacccaattaaaaaataggtgacggatctgattagctacttctccaaacaagatgcccaaatggctaataagcacatgaaaaaatgctcaccattcttagtcatcaaagaatgcaaatcaaaatatgagatagtattatacttcacacgcactgggatggctgtaatcgaaaagacagatgataacaagtattggagaggaggtgaagaatttagaaacagtctggtggttttccaaaagataaacatagagtcatcatataacctaacaattccaatcctagatat

SEQ ID NO: 400283 - DNA, 693 bp, Homo sapiens
ggtgaccgggccgcggcgtgtttcacaagtcgctcgctcgctcatccactcgggcggcggccgggcctcaggcgctgcgacccttttcccgctcctcccaggctgacgcgcccgtctcggcgccgccctcctcggcaccgactgaggcgctggcccgggagcggatcgcggggccgcggtggctgagtcacattcccggagccccgccacccaggacaccgcggccccggcccccagcgagcccggcggacccagcggctctgaacgcggacgcacagccttgttctttcacagccgccctttacctcactcccatggaaaccccaggtgttttcccaagctgggggcttttagtgagttcaagattcaagcctaagtcgtattaaaaattgctggctaggccgggcgcggtggctcacgcctgtaatctcagcgctttgggagcccaaggcaggaggatcacttgagcccaggagttccagaccagcctgagtacatagcgagacccacgtctccacaaaaataaaataaaataaaataaatagtggagcatggtggcccgcgcctgtagtcccagctactcgggaggctgaggtgggagaatcgcttgaggccgggaggtgaaggttgcggtaagccgagatcgcgccattgcactccatcctgggcgactgagtgagaccctgcctaaaa

SEQ ID NO: 400284 - DNA, 455 bp, Homo sapiens
attcagagctgcacagctagtgcaaacttttcttcaatatttctacataaatcctccttcctgactcacgttccattctgactatgaaaaatcaataagaccttgaccttgttgctttcatgtttcatgcactaattcataactagaattaaactccccccaaaaaagtcaatcaccgtgaacgggagccaggactagaatgcacctctagacagagcagccggcagcggctcgcattgtgaattttagctccagattgactacaagagcaaactaacaatcccaagaggacacacagaccctctgacggaagtggactgctcctgcaggacctgggagacaccgcaaatactgtgagcgccccaactgcggaagcgggctgtttgcctgagaaatttctgactttacctggagctgagtcaattaggagagccaagggaaatacagaggtagag

SEQ ID NO: 400285 - DNA, 744 bp, Homo sapiens
caaatcacctgtcaactaaggacctgtatttggaatacacagagaactcttaaaactcaacagtaagaaaacagtccaactaaaaagtggaaaagacctgatcagacatgcaccagcaatgacacagcattgactgttgggcacaggagaagaggcttgacaccaccagccaccaggaaatgcagattcagccaccacgcaggacacgaggcacctgcaccacagccgcagtgcaagagaatgctggtggtgccccaagctgccagggtgtggacctgctggaaatggaagacggcatggtggtttcctataaagttcaatgtacacagccacatgacccagcaatcccactgttgggtatttagagaatgaaaaacttaagtccacataaaaactgtacgtaaatgtttactgatgccttattcataatcatcaaaagctgaaattcaaatgcctttcattgggtgaactggtaaactgtggtatatctatgcagtgaaatactcctctgcagtgacaatggggagagactgacacattgggcaccatgggggtgggaagaggtgaaggaaggttgggggaaggcgccgtggtcaggtgtggcactaaggagatttgggggtggagccattctgtgtgtggactgtggtggtggtcgcgtgactgtacatgtgttaaagcttcaaacaaaaaagttaaaaattttagtttaaaatattaaaacatttttaaaaatgaaacgta

SEQ ID NO: 400286 - DNA, 435 bp, Homo sapiens
gctacctcaggatactgagaggtgctgctttccagctagagaaaggagtgataagcagttagcagctttgctaaatttgtttcacagtccttccaaacagctacatactgtacaatttttctctgacagtgccgcctcgctccagagaaaagtatgctgatatactttggaaagattttcaataaaaagggctttctaaataacttttagtttaaccaggaaatcattcaaccagaacccccttcccccaagtattctagttagtcaaagttttactgaaacatgtcagcattgaaaaatgcaaaaggcagctaagtaggtctgactaaaaaggtgtaagaaatcccacatctgtgcacagagcagcagtgtcgagtctcttcaactgttaggcatttcaaacctgccatctccaatgcacgactagtggaaaaa

SEQ ID NO: 400287 - DNA, 421 bp, Homo sapiens
ctaggctggtctctagctcctggcctcaaacagtcctgcttccttggcctccaaaagtgctgcgatcacagacgttagccagtgcacctggctagcaacttaatttgttatggtttgcttttttcccccagcgcttgttttcttttctttctagctgttttttatttccttttcaatttaaaagagtgaattcaacattccagctgaagacaatgtgatagccatgaagtctttgtgtgagaaagttaagagggaagttagtctactacagagatcagtagtgaagaggggcccagtgggatggctcacacctgtaaccccagcactttgggaggctgaggcaggtggatggcttgatctcaggagttcaagaccagcctgggcaacataagtgagatgccatctcaattgtgaaaaatca

SEQ ID NO: 400288 - DNA, 449 bp, Homo sapiens
taaggggctcttgcgttagtacagataagagatgaagatggtttgggctagggtttaccagtggagggagagagacggactaagcagaactggcagcatacttgctaatgaattaaaaggggatgagaggggaatgtgggaatggaaaaataaaagaaagaaaataattaagaaatgactacaaggtttgtggcttccatagcaaatagtgacactggtagtgacttttactttgacagcaaacaaaaaatcctgatcagaagcagtaaatactttccataaagttaaatagattagcaaggcaaataagatgctaaactttaaaagtataccaagctctgaaaaatagtttctcaatggtgaggtgcccacaatattttgctattattctaagtaagtgctttaaggacctgagctactgcatatttacagaatgctggcagccttca

SEQ ID NO: 400289 - DNA, 522 bp, Homo sapiens
tgagagatgatttttaaaaattaattatttacaatttaaagaaatgcaaattgctgaagagaagaagtttgataagttactgatagagagcaagtgttcaacaaataaactgaattgagcagaatggtcttttaaaaagctatgtgttctgggcaaatgtaaactggttaaagtaaaataaggcatttcactacattgttctttgggcataaagaacttaatgagctttaaaaatatgtctgattgctgggcatggtagctcacgcctgtaatcccagcactttgggaggctgaggtgggcagatcacttgaggtcaggagttcaagaccagcctggccaacatagtgaaaccttgtctttactaaaaatataaaaattaggcaggcatggtggcatacgcctgtaatcccagctactcaggaacctgaggtgggaaaactgaacctgaggggtggaggttgcagtgagcggagatagtgccactgcactctggcctgggcgatacagtgagactctgcctc

SEQ ID NO: 400290 - DNA, 447 bp, Homo sapiens
atggaagatcgctgacttgctaactgttagttggagtctggcctcttggacaagtgcttgatacaaatccagtggaaaccaactgcagtagcttgtcttggagacagtaactggcagcctctgactaaaatatctccatctcctcctctctgagcagcgtagacacccaattctgttgggaagtgaatggaaaataatatgggctctttcccttctttggattaaattcccatcgagctatttcccaaggctttaggccttccagtcaaatctggcttggaaatttgatgtaagaattcacttggacactcacttcagcaacatgattcaatttaggattatatgcacataagaaaaatctgcacagaagtgaccagcaggtcaaaaaccagagaagaaaaaatgttgaaaaatgccagttaataaagttagttttggtaagaacta

SEQ ID NO: 400291 - DNA, 875 bp, Homo sapiens
tgtctaaaataaatttctaacaatgtatcctttaatagttagactcatactttattttgacaaatttaagatagaaaaatatcataatgtgaatatagcagttgctctttttgtaacatggtttgggatgtgcagtgaaacttgaaaggacttgctttacaggtggtccctcttctggctgggtttcagttaattctgaattatattccagccattgcatttgcttgaaagaatattggacacagtaaaaaaaagaacaggtttggcattcaataataaatattataaagcaatgaaccaaaacaacttttaaaataattactgaaagcaaacttcagacttcatgattaaagctaagaactcatattttcaaaatagctttaacagtttctatcaatatataatacaataataggacacttatttttaaaaaacaagtgagtagaatcagagtaaatatgatatttcagatgactataaacagtaaacatcaattcaatatatttatatatcatttcagcaatatactctttgcccagctggcgataaaaactgtagttctatcatcaaaaaatgcatccctgaatgtcatctttgaacttactaagtgctgtcatcatttctacactccatctttggagggggtggcttagggactcttggtacatgcagatatttagttatggttataatgacaaaaagtaaatgtgccaggagtctgaagcagaaacgttgccttactttgttaagtagcttcacattcttttgtctctgtgatgcctcaggtgaagtcacactaaataattcacacaggtgctaattttgttgctctgtgtcagtacctttcagcttctttcttttcttcccttccccac

SEQ ID NO: 400292 - DNA, 727 bp, Homo sapiens
ggggagctactgtatttagatggtccctgacttactatggctcaacttaaaatttttcacccttactgtgagtttattagagtattaaatgcatttttgacttactatatttttggcttacagtggctttattgggacataaccccattgtaggtcaaggagcatctgtatatatattaattcaaatagaagtaaattaatgaaaaagagtcaccgctttgtaatacagtacaagttataaaaactgcatgcatgatccatagtaccccagtaagaatgatcccttattcttacatgaagtaattatagattttaaagtgttcacttacatgaagtaactatagattttaaagtgttcagtctcaggacttttttttttttggcccaggctggaatgcagtggtgcaatcacagctcactatagccttgacttcctgggctcaagcaatcctcttgtctcagcctcttgagtagctggtactacaggtgagtgccaccatgtctggctaatattttatttttaatttttagtagagacagggtcttgctccgttgcccaggctggtctccaactcctggcctcaagcagtcctcccatctcagcctcctaaagctctggtattacaggtgcgaagcactgtgcctagccaggattctttttttaaagatccaattcaagcttttcttcattttcttaggcagttgtcagttgattcagcctctgatc

SEQ ID NO: 400293 - DNA, 344 bp, Homo sapiens
cagaagtgaaacatctctaccgtttgaaacccgaaacttcggcagaattaaatcttcatgctccagagctgcttataacaactgatgcaaaagacaggcgatcaagtgcccccgcgagcagtgcccagccaggctgggccgcgaacgcttccaggaccagcgcctgcagaatggaatgcacgcttttttcttcctggtctttctgggggtggatatctctgcaagccaacccacacatttttttaatctccggtaacaagcagaaagacacctggactattatgctgtaaaactattttttataaagacattttaggaccagacattaaaagttattagattga

SEQ ID NO: 400294 - DNA, 232 bp, Homo sapiens
gtaaggcttaggaggtgagaaaaaaaggaaaaactcatctttataaaagaatgccaattaataaataaataaggcataaatttttaaaatcatcattttgcatcttccaattctgaaactgaatcgggcaagaatcaaaaatggaatgagccgggagcagtgcctcacacctatatcccagcactttgagaggcagaggcggatggatggcttcagcccaggagtttgagac

SEQ ID NO: 400295 - DNA, 572 bp, Homo sapiens
ttgacataatgcctcactgcctgagatcccatgagctttcttcccaaccctgttaggtggtccttggaccactaagaactatgtggttatggcccattgtctcctctttcccttcagtaaggaccatgttttacccagtctagcctgagactgaatgtatcctattaaaagtgtgtgttgaatgagggtgctccaggtctcagaaggcggtggggttaattactgctctgagcttaagcagggcagccagaaggatgtttttcaaaaagattatgattatgggccttctggttagaatactttgggcatcagacaggggtagcaacccaaatttggggaaggaagagaataaaatgacaagaatctcaaattggataagtatatacacaaaagccgccttctttccctctataatctctgttcctttcagtatatcctgggtgttcagtgaaccaaaaaatatacttacagtttttctctgtgcacttgcaagaaggcgaggatacttctaaccaaaatagcctttcccaggaacacctgtcagcaatgattttttttaaaaaacaaattga

SEQ ID NO: 400296 - DNA, 406 bp, Homo sapiens
ctcaacaactagtagtttttttcattctttccaggaaatcacatagaagaaaagaaaatgtgtaaaaatacattgcgtttatctgggttagggtttagaaagacaaaaagaactttggatatattcacaatagaaagagagttagtcaaacactgaaaagacattcctgtcagatcacctgcctcttcggttcactaagacacagacacatcaataagtagcaaaggatccatgcccttcttgactaggagagcaaaacctaattctctagctattctttgcctgattgacaatttttaaaaagatgaaccttcaatgattttgcaagttcctaagatccagcaaacaggtcaaaatacagatgacacagtgagtagtggtgccatcgtggtagtgtaaaatcctg

SEQ ID NO: 400297 - DNA, 1025 bp, Homo sapiens
ataaaacatctatttcaatatgtctgcaaaccaggagaaaacataatttataagttaccatttacaagacttcaagacataaatgatagggaagagcttcatagagaaaaacaaaattgtattgagatataccaaagaaagtgtataaaataggacaaagaaaccttgttcatggattggaagattcagtaactgttgatttggtgcaattctagtaaaaataatttcaaaagatttttaaatggaatttgataagctattgctaaaatatacatgaaagggcaatacatgagaaataaccatggcatttcacatgctttaaaatggaaataattattattaaactttaataaatttatactttggggcaaaagaatgggcaagttggtcagggagcccagaaacagcactgtagatatacagaaacctgatttatgacatagattacactctagaagagttgagaaatgtttggctcttcaataaagagaatatagtgaagttgagcccccatataatccatacccaaaattccatctcaagtggactgactacgtaaatgtgaaaagcaaaaatataaaatttggaagatagcatagaagaatgcctttatgacctcagtttttagcaatgtttcttacagctgggtgtggtggcttatgcctgtaatcccaggactttgggaggctgaggcaggagaatggcatgaacctgggaggcagagcttgcagtgagccgagatcacaccacggcactccatcctgggccacagagcgagactctgtctcaaaaaaaaaataaataaataaaaataaatgtttcctaaatgagccactaagaaaactgactacattaaaacttaacttctgttcatcgaaagaatacttttaagacagtgaaaagataaaccatacgctggagtaaaatgtttaaaaaatacacacaatattattccatttatataaagcataaaatcatgtcaaaatgacacatagtttggatataaaaatatagcaaaactaaaa

SEQ ID NO: 400298 - DNA, 558 bp, Homo sapiens
tgcctggccaatcagatgtgatcttttgctggcacttgctcctttggcccccactgcagtaaacactttcccttggatgttggttttctgttgtgtctggcagccacacagggctgcttgaactttagccagaggcaaatatttatacatcagagtgtgcagtgttcaactggtcaggcctgagagggagagggagagacctccgtgccttttagccaaagaggatatgtcctttttttccccttccctttccaccgtgacatggtaaagtgggaccatactggatgtcatttgagcttgctgcatgtgcttctctccaaaacgtacacgtgcgcaaacttgggatgtgctttcaaaagagaggacgtcctgacatttctgcctgctcctttaattcctcttggaaagtttacggttaatattttccctggaacattgtcaagcttttgacagtgcctgagtgtatgccgaactgtgaaattgagccggagaagcaagttgtgagaaatctgtttctactcagatccgtaaggtttatgggggggggaaaaaaaacca

SEQ ID NO: 400299 - DNA, 110 bp, Homo sapiens
cagctccaagggcctcaccttcctgccgccacctcctaggacagccagtccagggccatgaagaccaagaaccggcccccacggcgccgggccccggtgcaggacacaga

SEQ ID NO: 400300 - DNA, 655 bp, Homo sapiens
gtgatctgtggcagtgacttttcttgattaactaaggcaacaaacaaaatgaataaaccttcattttcaattaccaataatcacaccctggagaaacctcattgattacgatactgccaatgtacaaagtggtatgcagccttttcagattggcttctttcacttagcaatattcatttaatgttccccatgtctttttgtggttaaatagctcatttgttttgatcatgcaattatattacaacatattaatgtatcacagttggtttatccattcccctacttaaggacatcttgattgcttccaagtttggggaattaagaataaagttgctataaacagtcattgctgggttttgtgtagagataaatgttcaacacatttaagaaatagcaaggagcatgactggtggatcacatgataagagtgcatttacttttgtaagaaactgccagactgtcttccaaaaacgttgcaccgttttgcatcgccagtagcaattaatgagaattccagctgctccccagcatttgggatattcagtgttttttcttttttttttttttttttttttaccattctaatagatatataatggtatctcattgttactttattttgcaattcccataatgacatatgatgttgagtatt

SEQ ID NO: 400301 - DNA, 948 bp, Homo sapiens
tcagctcggtactgggtaacctatcatttctgtaatacgtatgtatcctctataatacatagagaatgcaaaaggaaaataatttgaaagctatcctattttatcttgaaagcaatcttttaaaagcgcattatacatttatttgaaagttatttggaattgtctttttccattctcttttcctttaaagaaatggtaggggaaaaacatctggtataccctatagtgttttactgtagtcaaggtaatataatagaaagaacacacgtaccctgggtttgaatcccaactgagccacttaccagtgttaccttaaggaatgtaattcttgtgaactcattttcctcctttatgaaatttgggatcattctgactctgagaggggagaattaagtcaaatgacattgtaaagtgtcttgcacagagcttgacacataggagaactcagttagtagtagctattactctgttatattactgttagacaaaagccagggctgtcatcagttacttacacttactcaagatcccctattcacctagataaggaaaaaacaattcctttatgtgtcattaattgcaatcgtcactctcttgaagtgggtcccctgcttggaccctgtaaagctttgccactaacatgttacccaaggcaggagactgcatcattccctgtaggtggacctataattgctgcttccctgacccgaagttgtattctagtgcactctctctacaatggaccactatcttttccacacgttacttacctaagtccctactgacttaccccctaaggtgcttcaggaattctgtacttctaacctgcagcctctacctcccaggttcaagcggttctcctgcctcagcctcccgagtagctgggattacaggcatgtgctaccacacctggctaatttttatatttttagtagagatacgggttag

SEQ ID NO: 400302 - DNA, 551 bp, Homo sapiens
taggatccccacccctatcataataccactgacattcttcacagaaatatgaaaaatagaatcatgaatctgttatattactgttagacaaaagccagggctgtcatcagttacttacacttactcaagatcccctattcacctagataaggaaaaaacaattcctttatgtgtcattaattgcaatcgtcactctcttgaagtgggtcccctgcttggaccctgtaaagctttgccactaacatgttacccaaggcaggagactgcatcattccctgtaggtggacctataattgctgcttccctgacccgaagttgtattctagtgcactctctctacaatggaccactatcttttccacacgttacttacctaagtccctactgacttaccccctaaggtgcttcaggaattctgtacttctaacctgcagcctctacctcccaggttcaagcggttctcctgcctcagcctcccgagtagctgggattacaggcatgtgctaccacacctggctaatttttatatttttagtagagatacgggttag

SEQ ID NO: 400303 - DNA, 626 bp, Homo sapiens
ttcactggtattgagtgttaagtaacaggtaaaaaggcacagaaaaccaataggaaattagagttttgtaactgggtgtctccaccaataatatttctctgactctgtatttttgggtaatgttgcatcctcctggttgaaaatgtattcagttatgtgatttgaagtgtttatgaattaagacaaattatcattactagttagaaatgtctcttccaaaagtagtacactatacaactttagtttttgtgctacttaggagagaaaagcagatattgccttattttgtgtgccctatccatttaattagaagctcaatgaaaatttttatcattatattatcacctctatgtggaatattgttaaatgttttagaaagtttgaaattcatttttaaatgtgaatcattattgtttgtgtggggggaggaatgtcaagttggaattatgaatcaggctttgccttaccaagtacttttatattaatagggattattttgaatttctgtaatacgtatgtatcctctataatacatagagaatgcaaaaggaaaataatttgaaagctatcctattttatcttgaaagcaatcttttaaaagcgcattatacatttatttgaaagtt

SEQ ID NO: 400304 - DNA, 1541 bp, Homo sapiens
  misc_feature (342)..(342): n is a, c, g, or t
  misc_feature (1310)..(1310): n is a, c, g, or t
tctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcgtaggaagtcgttcaggatatcagtatataatgcacagaagtgtgggttgtttgaaagccaancaggagaatcacatgaatccaggaagtggaggttgcaatgagccgaaatcctgccactgcattctagcctgggcacagagcaagactccatctcaaaaaacaaaatggtccagcaaggtggctcacgcctgtaatcccagcactttgggaggctgaggcaggcggatgacaaggtcaagagatcgagaccttcctggccaacatggtgcaaccccatctctactaaaaatacaaaatttagctgggcatggtggcacgcacttgtagtcccagctacttgagaggctgaggcaggagaatcgcttgaaccggaaggcagaggttgcagtgagctgagatgcgccattgcactccagcctggcgacagagcgaaaataaataaataataaaataaaatactcattcacttattcaaccaacaaatatttaccacgcacctatcgagtgttagacataggaatgtaataatgagcgagatagacggagactctgtcctcacgggatttgcagaccagtaatagttggaaggacacagctggtgtcgtgatcataactcctgtcagtgctgtgaggaatcctggtgccatgggaacattcagcagggatgtgtagcctatcagggaaacagatgggatcaagaggaagtgacgctcgggccagcgggagggtggggagtggacgttcagtttgagtgaactaataggtgaaagccctgagacaggaaagactgcatcatgtcagaggaactgcaaggcaggagtgtggcctgagggccaggaagggtctggggtgaggcctgaaggtcttctggacctatacacaaggtgtggatttgggcctattacctaagggcaatggaaaaaaggaacatttttaagaaggggagagagataatcagatttgcatgtttaaggccgggcacggtggctcacgcttgtaatcccaacattttgggagtctgaaggggntggatcacctgtggccaggagttcgagaccagcctggcctacatggtgaaacctcgtttcgggtaaatatacaaaaaattagtcaggcatggatggtgggtgcctgtaatcccagctacttgggaggctgaggcaggagaatcgcctgaatccaggaggcagaggttgcagtaagcctagatcacagcatttaaccccagcctgggcaacaagagtgaaactccatctcag

SEQ ID NO: 400305 - DNA, 577 bp, Homo sapiens
caataaattatataatttttgtcaattaaaaatattagaaaaaaatacattgggccaggcatgatggtttatgcttgtaatcccagcactttgagaggcggaggcaagaggaactcttgaggccaggagttcaagtccagcctgggcaacatagacccagtctctacaaaaattaaaaaactaggtgagtgtgatggcatgtgcctatagccccagcttactcaggaggttgaagtgggaggatcacttgaacccaggcgatcaaggctgcagtgagccatgttcatgccactccactttagcctgggcagtacagccagagcctgtctcaaaaaacaaaaacaaaagtaattggttacctcagaggggtaggtttggaagatgtggggtatggacggggctgattaagttttttttttttttaatatatccctgtattgcttcattttgtgcacaatctttaatacttttataatacaaaaaagagaaattttaaaaatgtgtttgctctatctccaatgtctagaacagtgtttggcacatatttggcattcaataaatgttggttgcataaata

SEQ ID NO: 400306 - DNA, 369 bp, Homo sapiens
taaaccccagagccggaggttgcagtgagccgagaccgcggcactgcactgcagcctgggcaacagagaaagactccatctcaaaaaaaaacttacgctctatacaaaaattaaattaaaatttatcatgtgtttaaattcatcctgtatttaaagaaaaaaagcttaatttttaatacacttgggaacaaaaaatattcgataaaatctttagtatctggaactaggcaaatagttcatagaactgacgccagaagtatgaatgataaaaagaaaaatggataagttggaactcttattttaaatttaggttttgcaaaatgcaaaatagaagataaaaatgaaaactatagactgggagaaactatt

SEQ ID NO: 400307 - DNA, 432 bp, Homo sapiens
tgcctgcataataagaaccttggtctccacaacctcttatttcaacctaaacatttcgattccaggtctgtagataaactctttcaccaattgccatcagaatatctttgaatccacctatgacctggaagcctccacttcgagttgtcctgcctttccagaccaaaccaatgtgcattttacatgtattgattgatgtcttatgcctccctaaaatctataaaatcaggctgcaacctgaccatcttgggcacatattctcaggatttccagaggctgtgtcatgggcatgtccctagccttggaaaaataaacttctaaactggttgagatttgtctcagatactttttggtttacggattcaaaacaatggcaaatcaggccactatagaaaaagatcacaaaacattgtacataacagaaaaaaagaa

SEQ ID NO: 400308 - DNA, 495 bp, Homo sapiens
atttctgaagtgactggcgttgttatcatactgcattattcacctactagaaagagaaaatagcccaaagttttccatttccattatggctccagtaattctcattctgttccgctgacttctacatgggaataaaaaatgttgtagcattctacacattgcagaaaatagcttacactcaaagcccttatcaagagaagaaagttttaatactattgctaccatataaaaagagacagcagtcatttaaaaagatagttttcatttcatgtttaataattatctccttaattattatgtttttgtaaatatataaagttagtaagtatttgggaaacactatgagtttgtttttttttttttttttttttttttagcaagggaagtttggtagttaaaaataaccacgattgggaggctgatgcgggcagatcacacggtcaggagattgagaccatcctggctaacacggtgaaaccccctctctactaaaaa

SEQ ID NO: 400309 - DNA, 274 bp, Homo sapiens
gcacctgtaatcccagctaatcgggggactgaggcaggagaattgcttgaacctggggggtggaggttgcagtgagctgagatcgcaccacttcactccagcctgggcaaaagagtgaagctctatcttaaaaaacaaaaaacaacaacaacaaaaaaccatctggtgctagaaggcaggattggtaggcaaaggggaagtaagtggagagagattgggattgaggacccagtcttgcagcaagaagaggaagcaagttattgaaggagatgtg

SEQ ID NO: 400310 - DNA, 326 bp, Homo sapiens
ataggatggtcaaaaaagacccatctaaggaggtgatatttatgcttagatctttatccctcccctgaaaatatgtagaatcaaaagaaaaacttttcaggaaggcaaagcaatttgaggaggcaacaagtagaacatacctcagaactgaaattagacaagtgaggctgaagtttaaatgttattcaagagtaagcaagaaagtcacacattatgttttttaaattatttccaattaagggaaccaaataaaaatacacagagggatactgaacagttaagaaaagaaggttgcagccaaaatgctagtcaaagtagtttcaggt

SEQ ID NO: 400311 - DNA, 921 bp, Homo sapiens
caggctagggagaggagaggagcctgaattctgctaaactgtagacatgaacaattgccagccattattccagaggtcctgcagataacatcactattgtagaacctgagattggccttttgagaatttttttctcagattttttgcatgtctgatacccatggctccacctggatccaccaaccagtggcttctgtgcccccacccagaagcaactgagtgcaagagaacagcttcagctcctatgatttcacctccaacccaaccaatcagcagcaagcacccactgcctagccacccccaaacttcctttgtaaaatccctaacctacgagctttccatgatattgatttgagtaataagtctatatccctgcgtggtgtggctggattcatgtcaattaaactctctctacagcaatgctgtcatctttgtttgtgcaactggcagggaaactaattgggcagttacaagtatgggatacttatgttccataattattactaagagttttaaatgagatagcacatgtgaagcacttagcaaaatgactggttcacagttaataataaatgggagtggtaattatcagtatcattcacacatatacacatgctttacatataatcacaagcttacatataattcttgtctttcagcatgtagaatttaagatgaactcaggcaagtaaggaaattgacattctagtcacaaaaaactgaaaggggtcaatgtaaccctatgaagtgcagtgtcagaatgaccagaattaccactgttaagatgataataatttcagtcatgcagtaaggtgatggttgtttggatgaagtcacaatgtaagtaaaggatgacgagatccttttttattagcaactggatctttttcccaaaatgcactaaattgaagccatcacatt

SEQ ID NO: 400312 - DNA, 811 bp, Homo sapiens
ggaaactgaggcctgcagagcttaagtaacctgcctgaggtcactgactgtaaagtggcagtgccaggactgaacccaggcagtctgagcacacagcacactctcagccctggataccagactgtgagcaacactgggggcaccctggccatgaggagtgtcactgatgccctgagaaggcactaaacctggagtcagacgctggggtttgagccgcagccctactgttgtctatgtgactttcggagcctgtccctctctgagcctgtttcctcacctgtgacatggagcagaagtttctacattgtctggcctcaggggtctaggcaaatcctagcagtgactgaatgggaagccaaggaagtggaaatgggacatggcccctacttcaagtagaatgaaacccttgtgacctgctgtaagcggaaggttgtgtagcatttcaatggggcagaaagaaatctgatactgaaaagcctgtttgggaacccttggactaaatgtctcagaagccactccattttgagcattacttctgtctaatcttaaatggtatgtgtgtgtgtgtacatgtgtgtgcatgtgtatgtgtgtgtgggaatgaaaagtcaaaatgacagcagggtgtctgagccagggataagctgagaggctataaagagggctaacagcccataaggtttatttgctcaacaaacagtgcagaaaggtcaaaaccaggtgctacaaaatccctttcttcttctagaatataaccataaaacagataacacaggcagttcctaatttgtagacaggatgtgctccaaat

SEQ ID NO: 400313 - DNA, 424 bp, Homo sapiens
attattttcaaatttttcaaattaaagatgaaaggaaggaaggagccaaggacggttctaagaatttgggtcaggcactttctgggaagtttgatgacagctatgtgggcctgggatcatccccgatgactatgtgttggaacaactttatgggtccaggtaactgggaagaagtaatttatctgagaagaaacaactaccaaaaatagcaaagccaggaaagataaacactaagaacaatttaagtcatttaagactagcttgggcagcatggtaagaccctgtgtttacaaaaaatcgaaaaaaattcactggatatggtggtgggtgcttgtagttgcagcttagtcagaaggctgtggtagaagaatcgcctgaacctgagtagttgaggctgcagtgagccatgatcatgccactgaac

SEQ ID NO: 400314 - DNA, 725 bp, Homo sapiens
gcagaaggatcacttgagcccaggaggtggaggctgcagtgaactgtgttcatactactgcactccaacctgggcgatagagtgaggttttgtttaaaacaaaagagagaaaagaaaattacattcaagtaaagtgttttcctcctgtccaaaatctccacataacaaaaggttaatatatatgatttgcaagttcatataaatcaaaaagaaaaaagaacaaacacaggccagatgcggtggctcacatctattatcccagcactttgggaggccaaggcaggaggattgcttggggccaagagtgcaagaccagcctggtcaacacagcaagatcccatctctgcaaaaaattttaaaaattagctgggcatggtggtgcacacctgtagtcctagctactcaggaggctgaggtgggaggatcaccagagcccaggagttcaaggttacagtgagctataatcctaccattgcactctagcctaggagacaaagtgactctacctctgtaaaaataataataaaaaaattaaaaagaaaatgacaaataccaaaaagaaaaccaaggcaaaggacataaggcagtttacaaaagaaatacaaatgaccaataaataggtgaaaggaaatacaatcacattagtaatcaaagaaatacaaatacattgaaatatcatagcattctctcctctaagacaagcaaacatgaagactaatgatgcc

SEQ ID NO: 400315 - DNA, 672 bp, Homo sapiens
gcagaaggatcacttgagcccaggaggtggaggctgcagtgaactgtgttcatactactgcactccaacctgggcgatagagtgaggttttgtttaaaacaaaagagagaaaagaaaattacattcaagtaaagtgttttcctcctgtccaaaatctccacataacaaaaggttaatatatatgatttgcaagttcatataaatcaaaaagaaaaaagaacaaacacaggccagatgcggtggctcacatctattatcccagcactttgggaggccaaggcaggaggattgcttggggccaagagtgcaagaccagcctggtcaacacagcaagatcccatctctgcaaaaaattttaaaaattagctgggcatggtggtgcacacctgtagtcctagctactcaggaggctgaggtgggaggatcaccagagcccaggagttcaaggttacagtgagctataatcctaccattgcactctagcctaggagacaaagtgactctacctctgtaaaaataataataaaaaaattaaaaagaaaatgacaaataccaaaaagaaaaccaaggcaaaggacataaggcagtttactaatcaaagaaatacaaatacattgaaatatcatagcattctctcctctaagacaagcaaacatgaagactaatgatgcc

SEQ ID NO: 400316 - DNA, 459 bp, Homo sapiens
acagagtttctaatcattttcctgctgcatggaaacatttgctactgttggacatattacctctaatagcagaccctattctactgcctcagctccactggagtctcactgagcctactctggctttggaggtgccaagtcaccaagagagattctcagaggcccattgcatctatttctctcttgcatcaactgggcatcatgcttagctaggtctgagttcttatctcacaaccaggaagacttaggtgcacagaccctggagagtgagtggagtaaaaattattcagcaagatggaagctctcagcaaagagggagtgtggggtgtggttcccctacccaaagctgccaatgaaaaactaatacttcttcataatcagctactaagaaatttgatagatgaaaaaagataatgaaagctggtgtaagcaatcaaaataaacatgagttaaccaaaa

SEQ ID NO: 400317 - DNA, 369 bp, Homo sapiens
gcttcactcatttgaagggccaaatcttatttcattgtatggatataccacactttggggtttgtttttttcattttgaaacaggtctttctctgccacctaggctggagtgcactgctacaaacacggctcagtcctgcgcttaaggaggcctcctgctttcagcctcccgagtagctgggaccaccgttgcttgctaccacacctggctaattatttcattttatcgtagaggcagggtcttgccatgttgcccaggctggtcttgaactcctggcgtcaagcaatcctcctgcctcaacctctcaattactcatcccaggctggagtgcagtggtgcatttgcattgggaatttgcattgtttcca

SEQ ID NO: 400318 - DNA, 884 bp, Homo sapiens
gattaaatctttcacagcacttatagaacaaaatcctcactccttcttgtggcctgcaaagacttggatcctatgattccagcctctgtgtcctacctcttcttatgccatctcctcctcgtccattgtcctctggccacactggtcattcctccttgaatggctggcttcttctcttttaggtgtcctggtggttaatactgagtgtcaatttgattggattgaaggattcaaagtattgatcctgggtgtgtctgtgagggtgttgccaaaggagattaacatttgagtcagtgggctgggaaaggcagacccacccttaatgtgagtgggcacaatctaattgctgccggcaatatgtgcaggcagaaaaatgtgaaaagagagactggcctagcctcccagcctacatctttctcccatcctggatgtttcctgcccttgaatgttggactccaagttcttcagttttggaactcggactgtctctccttgctcctcagcctgcagacggcctattgtgggaccttgtgatcgtgttgttgtggtggtattactactactcagcaagattctggttttacttctcatcttgggagttaccatcaagacgttaggtatggctgtgtgacccactttggccaatgaaatgtgaacagaaatggcatatgtcacttgtggacaaaaacatttaagcaagaatttcccttgctgtcttccttgactggagcgaccatggaagcctgtgttgagatgaagaggctgccaacagatcaaaacacttgaaaacttgagcagccacatggactacaactgtgctggagacttgcctggacccacagcaggcttggtatgcatggggaatagaattttgttgtattaca

SEQ ID NO: 400319 - DNA, 1008 bp, Homo sapiens
gattaaatctttcacagcacttatagaacaaaatcctcactccttcttgtggcctgcaaagacttggatcctatgattccagcctctgtgtcctacctcttcttatgccatctcctcctcgtccattgtcctctggccacactggtcattcctccttgaatggctggcttcttctcttttaggtgtcctggtggttaatactgagtgtcaatttgattggattgaaggattcaaagtattgatcctgggtgtgtctgtgagggtgttgccaaaggagattaacatttgagtcagtgggctgggaaaggcagacccacccttaatgtgagtgggcacaatctaattgctgccggcaatatgtgcaggcagaaaaatgtgaaaagagagactggcctagcctcccagcctacatctttctcccatcctggatgtttcctgcccttgaatgttggactccaagttcttcagttttggaactcggactgtctctccttgctcctcagcctgcagacggcctattgtgggaccttgtgatcgtgttgttgtggtggtattactactactcagcaagattctggttttacttctcatcttgggagttaccatcaagacgttaggtatggctgtgtgacccactttggccaatgaaatgtgaacagaaatggcatatgtcacttgtggacaaaaacatttaagcaagaatttcccttgctgtcttccttgactggagcgaccatggaagcctgtgttgagatgaagaggctgccaacagatcaaaacacttgaaaacttgagcagccacatggactacaactgtgctggagacttgcctggacccacagcaggcttgactggtctcgaattcctgggctgaagtgatcctcctgctttggcctcccagagtgcagggattacagtcatgaaccactgagcctggcccatcttggcacttttgatcgtggacttctaaccttcagaactgtgagaaaataaatttctgttgtttaa

SEQ ID NO: 400320 - DNA, 1014 bp, Homo sapiens
gattaaatctttcacagcacttatagaacaaaatcctcactccttcttgtggcctgcaaagacttggatcctatgattccagcctctgtgtcctacctcttcttatgccatctcctcctcgtccattgtcctctggccacactggtcattcctccttgaatggctggcttcttctcttttaggtgtcctggtggttaatactgagtgtcaatttgattggattgaaggattcaaagtattgatcctgggtgtgtctgtgagggtgttgccaaaggagattaacatttgagtcagtgggctgggaaaggcagacccacccttaatgtgagtgggcacaatctaattgctgccggcaatatgtgcaggcagaaaaatgtgaaaagagagactggcctagcctcccagcctacatctttctcccatcctggatgtttcctgcccttgaatgttggactccaagttcttcagttttggaactcggactgtctctccttgctcctcagcctgcagacggcctattgtgggaccttgtgatcgtgttgttgtggtggtattactactactcagcaagattctggttttacttctcatcttgggagttaccatcaagacgttaggtatggctgtgtgacccactttggccaatgaaatgtgaacagaaatggcatatgtcacttgtggacaaaaacatttaagcaagaatttcccttgctgtcttccttgactggagcgaccatggaagcctgtgttgagatgaagaggctgccaacagatcaaaacacttgaaaacttgagcagccacatggactacaactgtgctggagacttgcctggacccacagcaggcttggggcagctgtagctatgattccagaggtggcatctggcaggctgaccacctaacactggtgaggcttggggcaatagtacaaatggaggcccactatctaaatatttaaaaggtaaaaatcaagcgaacaagttgtcaaataaaaaatgtgtctgtcttcctta

SEQ ID NO: 400321 - DNA, 960 bp, Homo sapiens
gattaaatctttcacagcacttatagaacaaaatcctcactccttcttgtggcctgcaaagacttggatcctatgattccagcctctgtgtcctacctcttcttatgccatctcctcctcgtccattgtcctctggccacactggtcattcctccttgaatggctggcttcttctcttttaggtgtcctggtggttaatactgagtgtcaatttgattggattgaaggattcaaagtattgatcctgggtgtgtctgtgagggtgttgccaaaggagattaacatttgagtcagtgggctgggaaaggcagacccacccttaatgtgagtgggcacaatctaattgctgccggcaatatgtgcaggcagaaaaatgtgaaaagagagactggcctagcctcccagcctacatctttctcccatcctggatgtttcctgcccttgaatgttggactccaagttcttcagttttggaactcggactgtctctccttgctcctcagcctgcagacggcctattgtgggaccttgtgatcgtgttgttgtggtggtattactactactcagcaagattctggttttacttctcatcttgggagttaccatcaagacgttaggtatggctgtgtgacccactttggccaatgaaatgtgaacagaaatggcatatgtcacttgtggacaaaaacatttaagcaagaatttcccttgctgtcttccttgactggagcgaccatggaagcctgtgttgagatgaagaggctgccaacagatcaaaacacttgaaaacttgagcagccacatggactacaactgtgctggagacttgcctggacccacagcaggcttgactggtcatcgaattcctgggctcgtaagtgatcctcctgctatggcgtttccagtagtgcagggatcactagtgctagtgttatccacctgagccagtggcacaaatac

SEQ ID NO: 400322 - DNA, 522 bp, Homo sapiens
aatctgcgcatggctgagctgagtcctgagcgtctctccaggctgcagtccatgtctctgcaggctgcagtgaaggtgtgttccaggcttcactgggggagggcctgcttccctgctcactcgtatagttgttgcaggagtcagttcctcacagactgtcaggctaagtaaggatcttggtttcttatggctattggctaaagatcgccctctgcccttcatcatgctacggagtagtcctcagggcagcctacgacatggcagctgtctccatcaaaggtcacaagcaaggacagctggagagaacgagagcaagacaaaagccgcagtctctcataacttcatcactgttgcactctgtctgttaggtgccagtcactagttccagcctattctcagggagggaattggtggggagcatcttacaaggctgcccaccttgtcacctgtcacactgagacttacatggaaggtgacaactgggtcctgtattcccaagcctcgcattctccaggcccttgc

SEQ ID NO: 400323 - DNA, 456 bp, Homo sapiens
aattattaactctgtagagataggtattgagcttattccctctgcagctcctgtaagtgttttgcacatagcaagtgctcatcaaagattggttggataaattattgttagtagatgagaacttgtagtacatgaattttcgataattctacagtgggtgtcataacccctaaatattttggatttaggaaactaaaaattgtcctaattggttttttgttgttgttgttcttttctaattggattttgatggacaatttgatcagtgaatgtctcgctctgttgcccagggaggagtgcaatggcacacacgatcttggctcaccgcaacctccacctcccgggtcccagctactcgggaggctgaggtgggaggatcatgtgagcctgggaggtccaggctgcagggggccgtgatcctgcccctgccctgcagcctgggttatacagcgagac

SEQ ID NO: 400324 - DNA, 415 bp, Homo sapiens
gagaaccatggtccacatggcgcctgtgagcagagatgggggaaagaggagacatcactgggctgcagaggtcaacagggttgtggaagtgtcttttattgcaattaagttttctagtcatgaaacctcttcgaggtatagaatcagctctgaaattctcaaagtgttttgatcatagtatttaaggatttatttttttaactgagatttacattactatgtatttgcagtaatgtttttgttaaaagttgtatcgtaatgtatttagccagaacttagtgtctgtgagaaagaaaagatactagaacttcttactaccttctaagatataaagtttaaaattatataatgtaaccagtgacttccctgttttaaaaaatcacatactcaaaaaaataaacttactgtctgtata

SEQ ID NO: 400325 - DNA, 513 bp, Homo sapiens
ggctgtagtgcaatggccctcatagctcactgtagcctggaactccttggctgaagccttcctcccacttcagcctcctaagtagtgcaccatcacacctggctaatttttaaatatttttgtagagagagagtctcactgtgttgcccaggctggtcttaaattcctggccttaagtgatgctcccagcttggcctcccacagctttgggactgcaggcatgagccactgtgcctagcctgtttgtctgtttgtttgtttgtttgtttttaatagagttggggtctcaccatcttgcccaggcaggtcttgaactcctgggctcaaacaatcctgccttggcctcccaaagtgctcagattgcaggtgtgagctagtgcaccaggccttaatttcttttcttttttttttttctttttctgagacggagtcttgctctattgcccaggttgcagtgagctgagattgcaccactggactccagcttgggtgacagaacgagacttcatctca

SEQ ID NO: 400326 - DNA, 488 bp, Homo sapiens
gcaaaaatattgcatctaccagcattttcagttccaattgctaatccagcatttgtggatagctgcaaactgtgatatatgggccaaggttgctcgggtgattggtttactggcttcgcacaaaactgatctccaggaaaatacacctgttgttgaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtactggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaat

SEQ ID NO: 400327 - DNA, 454 bp, Homo sapiens
gaaataggcagtttgctgtctctgcccagtagctgcagcacagggcagttgagcccagaacggccaaacctctgttgccacagaacccaggtcccaggtccccagcctcccttgctccttgccgcccacatcactcaccagcctcactggccttggaactcatcagtcccggcttgagagacacaaaggggatttcctttcgaagtacggctggacaagggggacctctgagaagaggggctgcaagcaggggttgcgccaaggccatgggtacttctaggtcaggccgcaccctccatagttagctggtcatgcagcaggaaggcaaaaggtcagctccctgggaagcaccggatctctgggcagtcactggggactcgccaatgcactgtattagttttctgttgctgctttaacaaacttggcagcttgaaacaacagattctcttatagc

SEQ ID NO: 400328 - DNA, 251 bp, Homo sapiens
ggggttgcagtcagccgagatcgcaccactgcacttcagccacctgggtgacagagcgagactctgtttcaaaaataaataaataaataaaatagaattctgaattttatttttaataattattttgtaaaaagaatgtcttgttttttggagttgttgaatttattgaattgacaaaaattatgtacaagagggtacaacatgatgtgattgaagtatgtatacgttacaaaatggctaatcaagctaaa

SEQ ID NO: 400329 - DNA, 315 bp, Homo sapiens
ataccttttcttaaagggggaaggcattgtagaaaaaggggcaggtaggtggtaaagcaaatttacggggtttttgtttgtttgtttattgagaaagagtctcaactccagcctgggcgacaaagcgagactccatctcaagaaaagaaaagtggattgcaggccaggtgcggtggccctcacttgtaatcccaacacttggagcggccaaagctggaggatcgcttgagcccaggagtttgaggctatagtgagctgtgatcataccactgcactccaggcagggcaacagagaccctgtctcaaaaaaaaaaa

SEQ ID NO: 400330 - DNA, 467 bp, Homo sapiens
tttttttgatgagctatttgccaagataaaacgtatggttttttaaaaaggaagttttaaagtacctatatcgagtcagcttacattgaaaaaatgtcaagcttgttaaaatgattatgtaacaaaatgtattctgatttgtatttcagaaactaaaaaataaaatgttgaaagaaaaaaacatcattcttgtatttgtgcattttctttccttcctgcctttacctcagcaacatatttaatacctgtctatatcactcattgagtcaaaaactgtggtcacggtaaaaccctatttcttcttatagccaataagcccttattcttcctattttaggatttgcatctgaagtagtgaacatactttatttgctttacatgtgccattaagccctacatttaaatcaaaccagttgcaaaaaggtttatatatttgcattttaaaaaattaatcttacacagcttta

SEQ ID NO: 400331 - DNA, 499 bp, Homo sapiens
attttctatatatttcatggagctcctatgaatgaaattgcttagagactttcagttttacaaagatactttttgaattctgtttcatcccagctacagtgcatactaaaactgttttcaaggagcttacagacaactgggcagaccttttttgttacttccttttaatctatactcctccaaaatttacctgggtgaattttgtttttgctcaactttagttatttgctcaactttattccttacattgcagtaatttgtttgaatgactgtctagagacatggagagacacggagttgcttgagggtacagtgcctgtagatactcaataaatatttgtttaattaagaaaatttctgttatttgtgtgctcatacataccatttcagtctggtgagtattgttctttcctagagtttacttttaatcttaagtattttccaggtcctttgttgacttctgtttaaaccacagtacacacacacacacacacacaca

SEQ ID NO: 400332 - DNA, 199 bp, Homo sapiens
gaagctaagttgtttatctgaacttctgagaaaccaggagagtaataacagccaaatccccaaacaggctgatccttgccggtacaataaggagttctcttctgctttcacccttacaagaaaagcagcttcgaagtgagcgatccgtgttttctgtttccgctttcctcagcccttccgtctagaaaaccagcctcct

SEQ ID NO: 400333 - DNA, 359 bp, Homo sapiens
gatcacatctataaatatgggaaaataataacaataaactaaaagtaaattttgaatcaatttcaaaggattgttgtggggaccaaatgtgataatatatgtatgagttctttgtaaacccataaaaggctaacaaccagtaattttagaccaaataacttaaaatgtaatttattttcaaataagaataaaaagttttcatttatattaggcatttatgtgctattataatttttccccttaaaaatgctgataatctaaatgtaaaaagtatcaaggcttcattcagtcaaatgttaaaggattttaattcattcttatgtgtatattaataaaatgtaatatttgtaaaatgcata

SEQ ID NO: 400334 - DNA, 313 bp, Homo sapiens
ccagaggctgcctgcattccttggctcatggctcctcttccatcttcaaagccagcaaccaaccaggtctttctcacattgtgtcactctggtttcctcttatacctttctcttctacttgttatcacacagtcctgcctcaagatgggtttgggcaagaacataattgccccaagtccctgacataaacgggtgtagtatgcgcatataacctgcatcctccacattgtcatcaatagtgacagaacccttgggataacactgggcccacccagataatccaggctaatctccccatctactggtatgaaac

SEQ ID NO: 400335 - DNA, 562 bp, Homo sapiens
ctcggctcattgcaacctccacctcccaggttcaagtgattctcctgcctcagcctctcgagtagctgggattacaggcacccgccatcatgcccggctaattgttgtatttttctgtagagatggggtttcaccatgttgtccaggctggtcttgaactcctgacctcaggtgatccacccgcctcagcctcccaaattttgggcgattacaggcgtgagccaccgtgcccggccggggtccctgtttttaattgcagagaaacctaagcttgccttcagtagttactcagagttcaggtcttttttaaagattcttcacctgtagatgaagaagagttgcattatgccttccactgattagagatcaaagatgaattctctttgtttttgtggggcagatattctttgactatttgacaacagactctgaagttacatgtatgtgactgctgccctgagtattttattgagcactgctttgttagatttgcctgggaaactctcccccatgtttgggtgagagagagatggggtgaaatttttccaccttgactacagca

SEQ ID NO: 400336 - DNA, 314 bp, Homo sapiens
aaacctcaaatcatggagctagaaatgttaaagaatactcaatgcattcttaaccccttaatggttataattaataagtgacagaaatcttcctcaaccaaacattctaagttcctcaggaattattggggaataagatatgtcctcataatgatttttggtgatgcccaaagtctttcagtcatacatatgattattcttatttaatatacaacttacctgtcttgatgtaaaagttgttagcttccccattgaacatagataaattccttatggggagaaatccttgcctagcaattaatagtccatattga

SEQ ID NO: 400337 - DNA, 328 bp, Homo sapiens
ttggcgggtctctaggcttctccgccgacccctgctcatgctcagggccccactcacatcgcttgaggccccccgccttgcctctgccgccccgcttacatctcgagcctctgagcagtagcgtcagtgcgttaaagccggggtgtaactttgattactcttttcccgccttggtagacttccgtcctctcccatagagaatgaatattgtgcctcgagaataatggagcggattcaaagcctctgtgcttggatctttagggcccggtacctgcctgtggggattcccagatcccaaggacttggttctgaatcagagacctttgat

SEQ ID NO: 400338 - DNA, 125 bp, Homo sapiens
gggaaggggcggagctagtgcaaagcaggtgattacgtgtcacttccgggagatgggatgacctcattgtgtagttagacaacacccccccccaatcaaaatgtctatgtctcacctctttggct

SEQ ID NO: 400339 - DNA, 718 bp, Homo sapiens
gcgcagcatagcaagtcaactaaatctttctgatccaatgaggtttgctcattagattaagtgaaaatgaacttgcttcactgtcacaatcacatgaatagctgggtaggttttccaataatcaaatggtccatcattggtcacacatcatagatagggctggaattaaccattgcagaaagtataagatcaaatacatgaagccagtaatacaaaataataccagacattaacaccagtcatcatagaaaactacactcctgagagatttcattagcttccagggaatacagaactgcggaatacttgctcaaagtagaaaaaatattgggatgaaatgattatcttggaagtcatcaattgtagaacaaagtaagatttcaaaattatggttcaaaaatttaaaaagttcttaattaaatatagatatgtgtagaattaagacttcttgaccatttgtcattgaaggtgcaattataccttaatgtctacctggtaactagctattactatttttttaatgtactcatcagtgtgttttatttaagttaatcattagcttgaatttgaattgaggtcagcttaaatcttagaataactgataggttcctaattaatttctacttgaattttaaatctaaaatatctcgaatctaaatatatgcctcaagcagaaatccactgggtgcttcttgctaggagatgtaggagacacatt

SEQ ID NO: 400340 - DNA, 483 bp, Homo sapiens
caagggaaggaactcctggggctcccagaagctggaagaaacaaggatccttcccctataggctttggagggagcgtggctctgcaacaccttggttttggacttctagctccagaagtgtaagagaataaatttctgtgatctcatattcagttcatggtgctatatcatggtagccctagaaactaagatacacaggtatgttggatgtatgggtcaggcccacacccagggtgcatacggcctttggttaaaaaaaaactctcatttctgtggggaatccattgccagtggtctggatgacatggccactgcctctcttcagggatgtgcacaagaccctggcctggccaatcagaatacctcatgcccaggaccacagtaactgggtcaggggttgtcaagatttatataaatgatttacataaaatgtttaaatgttttgttaaaatatttaaaataaaaaatgtttctaagatttca

SEQ ID NO: 400341 - DNA, 508 bp, Homo sapiens
tgtgtgtgtgtgtgtgtgtgtgttagaagggtgtggacgggaatgtggatggattgatgaagggtggtagctgtcagtttacataattttcatctcctggtcctgaagtttccttgaaatcaattctactgcaggcagcagccttgagcttacagagctgatataaaacaaccattacagtccaatatcttgcctgtttgcaaacttcatttaaaactggggaaaaaaaagacccaggaatggttttgtaagaaaggaaaaaagaagaaaagaaaaccacagtgaagctttaaactagtttggataaatctctaatcttttatttgtaaccttttacaagctttatttcccgtatatgaaaagcttcttttatatgggcacgacagacttttcctttggatttttaattagagtccatcaattgtagccatatttaagaatcaatataaagtaatccttcgagatgggataaggttttaatcgaaaatctaatttcccactctttgca

SEQ ID NO: 400342 - DNA, 625 bp, Homo sapiens
cattatcataatgggagtccactcctattaatcagaacttagagaccacatgttgtgttcattatccagaaaatgtatcaagttgcaaaacttaagtagaatgctaaaaattgggatccacagtattaatgagctaaaaattgacaagtgcatcttagaaaatgcttctgtgagcaaaaaaaatttgcaggctcatacgcaatgaattggagtgttcaacacggtttaattggcggctgtggatgtcttgtgcataattgaggttgtaaagatggatgcatgtggtaggcatggggggtctaaatgggtgagtgtgtattgtaagggaatccgtcccttccgacatactgcaggctgggttgcagatacagtgatccatgtttatgtaagcaaggtggaaacttctgatctagaagggaaaaaacaggtgcttttgtatgtttttctttcaggaaatagttcacattttccagaaagaaaagtttttttttttttttttttggagacggagtcttgctctgttgcagtgagctgagattgtgccgttgcacgccagcctggatgacagagcaaaactccgtgtcaaaaacaaaaagacaaaaaaaccctgtccttacaaagaaag

SEQ ID NO: 400343 - DNA, 300 bp, Homo sapiens
aaatagagaatttctagtgacaaaaacttggggtaggctctaaatctcctacagtattgaacaattcttggtctaactcaaatgtatgtaatagtaaataatgaaaatgaaactttgctatatttattcaagctgtttgccagctagaaaattaatatttggaaattcaaaaataaatctaaagaatattcattgggcagggcacaatggctcatgcctgtaatcccaacactttgggaggccaaggtgggcggatcacctgaggtcaggagttggagaccagtctggacaacatggtca

SEQ ID NO: 400344 - DNA, 413 bp, Homo sapiens
tagataccaggtcttattgtgttgcccaggctggatctcaaacacctgggctcaagtgatcctcttgcctcagcctcccaagtgctaagattacaggtgtgagccatcatgccaggtcaattttgacatcttaacaatattaagtttttcagtccatgaacatgagattctttgtttctctattttcttttatcagtgctttgtagttttcagtactggtataagtctttcactttctcggctaagtttatctctaagtattttattctttttgatataatcgtaaatggaattaattgttctcatatcttgtttggattattagtgtatatatcgttagtgtataaaaacacagctgatttttgtgtgttcaatttgtaccccacaactttgctaaatgcatttactggttt

SEQ ID NO: 400345 - DNA, 422 bp, Homo sapiens
catgagccgccatgcccggccatatgtgcacaatttttatgtgtccataaaaattttaaattaaaaaattaattaaaaacacttcaaagcccaagaccttaaatgtgatcactggttaaaccagtgagtatcttctattgtaaaatataaatgtgaattagagaagaatctagaccaaggatagacaaactatagcctataggccatattcagccacaccatctgtccttacatggaccataagcaaggattagtttttacctttttaaatggttgaaaaaatattttgtaaataaagttgtattggaacacagccacaccaatccattttcaagctgcccaaggctgcttttgtactacaagggcatccttgagtcatgacagcagagatcacagggcctgcgaagactcgaatatttact

SEQ ID NO: 400346 - DNA, 397 bp, Homo sapiens
  misc_feature (3)..(3): n is a, c, g, or t
  misc_feature (45)..(45): n is a, c, g, or t
acncctgtaatcccaggactttgggagccaaggccggtggatcanctgaggtcaggagttcgagaccagcctggtcaacatggcgaaagctgtctctactaaaattacaaaaattagctgagtgtgttggtgcgcacctgtaattgcagctactcaggaggctgaggcaggagaatcgcttgaacccgggagtcagaggttgcagtgagccgagatcacaccattgcactccagtgtgggtgacagggtgagacttcatcaaaaaaaaaaaaaaaagatttgataagaaacgtttaccatctattctctgaagttggctacctgaagacctcatctacatatctacataacaagaaacttggcttccacaattctccttatcttcaccccaagcaat

SEQ ID NO: 400347 - DNA, 651 bp, Homo sapiens
ccaaattacaatagggcggtagagctctttaactagggatcaggttgctacccttggagtgctggtaaccatgtcagacgatgctgtttgaacaatggagattcatgcccgtgtttttctgttttaatttgggtgtgaggtcaacttagtcggactagcttttaattctaagtttctctttaacctgtgattgatatgccacattgcagtatgttctttgctctaatcctttactatgctagcgcgtgtccaaacagaaaacagtttctagtctcaaggaagggaaagaaaaccacgaattccaaacaagttttctgatgtagaatttccaccagatagctggtgccctctgctggtcatgtaatcgccaacatgctctattattaaactatcaattaaagccggtccgtgatgaggaacaggagagatcactggaatgcagctgttcaggcctgtgaccccagcattctgtgggatgcagcatcttctcatggagctaagccagaggaatttctctttgttcctcaaatttgagatttctttatgaagactagcgtctctacttagatttcagagggctggtgaaagtggtttgtgttctttatccaggtgaatattccagtctgacgtctgtaactgcggccatccgag

SEQ ID NO: 400348 - DNA, 134 bp, Homo sapiens
tgttttttttaacttctgctttgaaaaccttttgtgagaagctaataaaatgtatgtttaagaatttgttatttttatgttatttgaaaattattcaaaattctttttaaaaattcctttccatcacccccaga

SEQ ID NO: 400349 - DNA, 537 bp, Homo sapiens
acctcctgggctgatcttttgccatcttttctcatgcacttcagtgttcattcactaaagggagggaaggccttccgcactcacgctttggcccggctcacgctgcccccgcagcacagccacagcacacctcaccttcaccaccttcctcccgataaactcagccttttgttaggacctgtctcatgtgttaattcctctgctttctctgtaaagtctttctagacacctcccttcctactaaaaagccataattaattaattgttccctgtgtgtttatgtcactccagcccttatgacaatgtaagtggcatcagtgttgcctgtgccccatctcccttctcaagtgtgaaccgtttaaggtacaagctgtatctgagccagcttgatgggagcatgcctctctctaacaggtgctcaattagtatcaatatttccatctactaaattgaactcttataaaatgtccatgcttcttaacttagactcctgcagttcagaatggaagactagaggttaggggcaacaaaaaaagc

SEQ ID NO: 400350 - DNA, 687 bp, Homo sapiens
caaaagatacaaatacaataaccaaaatagggtttaaaagaaatccttttcatctataactatataatctacatatataaattgttctacaaaaaaaaaaaaccatggactacttaaaaactgaacatggctaaagcaataaaaattaccagtgtgaagaagattataatgttttaaattaaaatataaatattcattaattcaagaaataattactaagttcctactgtattataagccctggatacaaagaggacaagaaaagcaaatactctgttatgccaatagatgagcagaaagtcaaaagaaacaaatgcacaaaatagttccagatcattacagatactgaaaattaagaataaggacagctaaatggggtgatgtgatttaagacaatgactggctaggggacttctaaagattcagtgaataaggaaagctctctgaggaggcaatgttaaagatggtacctaaatgaaaatagggcaaatagccatacaaaaatgtgctggctggaacatggcttatttcagaacataataagggcaatgtcgatgaagagcaatgtgcaagaataaagtagtacaggataaggtcaaaggctaggcaagggtagaccatgtagagcttaggttttattctaaacatagtaagaagccactggaaggttttaagcaggaaagtaac

SEQ ID NO: 400351 - DNA, 314 bp, Homo sapiens
catacaaaaattagcagcattactatacatcaataagaactagctgaaaaagaaatcaagaaagcggctgggcgcagtggctcatgcctgtaatcccagcactttgggagggtgaggcaagtggagcagttgaagtcaggagtttgtgaccagcctggccaacatggcgaaaccccatctctactaaaattacaaaaattaaccaggcgtagtagcgcatgcctgtaatcccagttactagggaggctgaggcaggagaattgcttgaacccagtggatgcagtgagccaagatcgcagcactgcactctctag

SEQ ID NO: 400352 - DNA, 435 bp, Homo sapiens
agctcactccatggaggttcctggctagcctatctggattgcggtgggccttgaaggctttcttggctggcaataattgctttaatgaccgacggccttagtagacatctacaggtttcggcctctgttttcgtggtaagaaggctcagggccaggcatggtggctcacgcctgtaatcccagtactttgggaggctgaggcaggtggatcgtctgagctcaggagttcaagaccagcctgggcaacataacaaaccccatctctactaaaaaaattacaaaaattagcctggccttggtggcacatgcctgtagtccaagctacttgggaggctgaggtgggaggatcgcttgagtccgggagactggggttacagtgagctgagattgttccattgaactccagcctgggcaacagagtgagagtctgtctca

SEQ ID NO: 400353 - DNA, 315 bp, Homo sapiens
atttggtccaaagaaaggttagtagatgcagagaacagccaaagggactgaatctggagacaactctaccccagcaaggtgtttgtcctgtgactggtgggttaaaatgggaatgcaacaggcaagttgtttgtgatgaataggtattgctttcataatcagaaaaaaaattaagaccatctttcagaaatgttctaaaattcgattgtgtgatggttgcacaactctgagtatactaataaaaaccattgacgtgtacattttaagttagtgaattttatgacatgtgagtcatatctcagtagagcagttaaa

SEQ ID NO: 400354 - DNA, 359 bp, Homo sapiens
cattgtctctattactagaatctaggcgaatttgctttctgctgcaaccaaatgggcagttgtccagttaatgacggtttggatattgtgaggcatgttttgtaaaaaaacacattttcttttttctttctttttttttttagagacagggtcttgctctgttgcccaagctggagtacagtgggtgatcataactttctgtaacctcgaacccctggactcaagtgatcctctcacctcagcctcttgagtagctgaggcaggagaatggcgtgaacccgggaggcggagcttgcagcgagaggagatcgcgccactgcactccagcctgggcgacagagacagagaatccgtctcaa

SEQ ID NO: 400355 - DNA, 489 bp, Homo sapiens
aattcatttgacaaaactcaacattccttcatgataaaaactctcaatgaattatatataaaaggaatatacctcagcacaaaaaaaggccatatatgacaaatccacagctaacgtcatactgaatggggaaaagctgaaagctttccctctaagatcaggaaaaagacagggatgcccactttttaccacttctatgtaacgtaatgttgaaggacaacatagtcctagccagagcaattagacaagagaaagaaataaaaggcatccaaattaaaaaggagaaagtcaaatttccctgtttgcagacgacatgatcttatatatagaaaatcctaaagatgctaccaaaaaaaacctattagaactgataaattcagtaaacttgcaaggtaaaaataatcaactgcatttctatatagtaatagtgaagtatctgaaaaagaaatccagaaaacagtttcatttacaataatataaaaaaaggaa

SEQ ID NO: 400356 - DNA, 490 bp, Homo sapiens
gtgtgtgtgtgtgtgtgtgtgtgcgcgcacgcgcgcaagtacttgacactctgtgtgtgtgtgtgtgtgtgtgcaagtacttgatttgtgcatacaaaacagggaatgtggatgagaaggcaaagaaagatggagaatggcaataatccctattccaacctaacccataaaattcaaaccctttgaaaatatattcttaaaatcattacaaatgtatgctcccactgtagcatcctagttataatctcttccttaaagaagtttggagcccagttgtatgcctaaaaattaccattaacttacacaatactgaacaagccagggctggtttaagtagtatgcctgcctgttaagtttcttactgagtcattcacaatgaagctgattcaggaaatatggagtgagacaaagtaaaggaaatggtgaagatatttctttatttggaattttcctgtgttctattcttcaggaaaaatttgacctactttga

SEQ ID NO: 400357 - DNA, 265 bp, Homo sapiens
caaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagcttt

SEQ ID NO: 400358 - DNA, 323 bp, Homo sapiens
ggccatgagtgcacatgctgaggctatcaagtccctcataaagcccaaggaggttaagccgacttgcctacactgcccaccccaagcttgagaagcatgcttgtgcccacaatgccaaggggctcaggctgtgccagccaaaggccaaggatcaaatgaagggccaggctgcacctccaccttcagttccagctcaggctcccaaaagtacccaggcctgtacaaaggcttcagagtagagatctctctctgccagcatgaggtcaggactggtgtccccttgcactatttgtacaaataaacctgaggcaggatttgtttca

SEQ ID NO: 400359 - DNA, 537 bp, Homo sapiens
tgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaac

SEQ ID NO: 400360 - DNA, 411 bp, Homo sapiens
cgatccacccgcctcagcctctcaaagtgctgggtttacaggtgtgagccaccatgacaggcctcaagtagttatttatagcagtgtgataacagactatacaccagccccagaggagcactgaggcctggatcatctttgggcagaacacacagcttcgatgcaggatcctcgtgtttaaaatacaaggctggatctggggctgtcagttgccagaacaagtccagagaaaacacaaagagaacaccacccagccctgacaatgttcttggctgagccagagcccctgaggcagccgagtgaactccatgacagaaacttctctgaaggcttgagaggaggggagaaaggtggagggctctggcccatgacaaggccaacaagtccactccaagccaggtggagggggcc

SEQ ID NO: 400361 - DNA, 426 bp, Homo sapiens
gatctttgagcttggggcctaaggcagttcaagagacccctgagaaagaacattgacccccgaaaaaagcagctttaaaaaattgtatattttgtcgagacgggttttgccgtgttgcccaggctggtctcgaaatcctgggctcaagcaatcctcccgcctcagccatccaaaagtgctgagattacaggcatgagccatcacgccccgccaaaagcagcttttaagaaagggaagaaattccagggccgggcacagtggctcaagcctgtaatcccagcactttgggaggccaaggcaggcggatcacctgaggtcgggagttcgagacgagggtgaccaacatggagaaaccccatttctactaaaaatacaaaatgagctgggcgtggtggcacgcacctgtaatcccagctactctcaaag

SEQ ID NO: 400362 - DNA, 474 bp, Homo sapiens
ctggataccctctaatacttctctaaatcctaaagggattaaaaataaatctatacctggacacattgtcatgaaactgcagattatcaaagatttttttttaagagctcctctagaggaaagacagatcacgtacaaagggacaatcctcatcctaatagtggacttctcattagcaacagctggtcaatgaagacaatgaaaggagagattctaaaacccagggcaaggcatagaacacaagaaacaaatgtgggcctatcaaatgatacaatgttatacattaacttaactgtgaaatactgaggaaggagctggtaggccagtgagtttggagttacaagaggaagagcagctgggcaccccgtggctcatccctgtaatctcagcactgtgggaggctggagaaggaggatcactttatcccaggaactcaagaccagcctggacaacatagtgagaccccatctctac

SEQ ID NO: 400363 - DNA, 545 bp, Homo sapiens
cgattcaatttatgggtgtattttaattattgaacaaaaaaaatgaataattagaaaggatacctaagaaaaaatgtccatcttctgtattgtcctgttagtgaggaactatgaattgatttttccccttttatgaaatacaaatatttgcacatccacaagataaagagaaagaacaagaaaatagaggaatgagacactctgtctttaggcccataataaatgttccgttcgcccccatgccggagccccaacctctaccttacagagctgcagtgatcacatgtcctggcatgccgttctccctctccaacagtgtcttcatatattatctaaacagctggtttcatgtgtatattaccctacacagcctcatcttttatgacgttggatataagttataaataaaagatcgtgaatttagcctgttttgactgagctcgttggactttaaatgggaatcattgagacctacaaatgtacatttccattgttttgacgccaaggtataatgcctggagttcataaataaaattatataaatg

SEQ ID NO: 400364 - DNA, 216 bp, Homo sapiens
gaggtggagtctcactgtcgcccaggctagagcaagattccttctaaaaaaaaaaaattatatgaatttatgcagaatgaaaaaaatcaaattttcaagccaggagtggtggctcacacctgtaatcccaacactttgggaggccgaggcgggcggatcacctgaagtcagaagttagagaccagcctggccaacatggtgaaaccctgtctctac

SEQ ID NO: 400365 - DNA, 1140 bp, Homo sapiens
caaaatcatgtggatatattttaaaagatccagcttacttctgtttctgtccatgaaagattaactaccacaagaattgccctctaacagcaggtgattagagaactggacaaaaatctaggaaacagctgttttcagacttcaggtaacagtagaagactgtaattcttaactgaaaggaaacagatgaagtgagccctgggattgcactgtttgcagtatgaggagaaggacccaaacatagtctagtggtgtgcatgagttgatgagacagaagagaaaagttcattggcggagaagtggctaggatatataggaaataccagagagaagggagctacagagatagaagagagcaagagcaggcaagtgccagtctagagatttctagtagggtctcctcaaatctttgactgaatactgattgagtagccatggtacacaataccatgaggctggagaaagaaagtgatagggcagttctcagagctcacatagggctgggaatagtttgtgtttccatcagccagcatagagacatagaaccttgaacagaaacatcagaagggtaatgccatagtagtgggaccaaattagtctgaggctagtgctgcattggacttcttctaacaaaaattgaaagcaaacattgaaaggatcaaattgatttaaaataatttatttgtgtgctagaacaaagtccaggatcctttaagataatacagtaaaatccagcaccaagaatgtaaaattcacaatggccagtatctagtcagaatttttcatgtgtattggggatgagagtagtgtggaggggcaaaagagggcttaccaagagggcatcaggaaacctttgggagtgttgggtatattctaaaagtgtattgacagttacatgtgtatatacatgtgtcaacacttatgtatgtagtttaaacatattcactttattatatgctagttatacatcaataaagctgttaagaatgatcaggtatgcaaagaagcaaggaaatatgatccacaacaaaaagaagaaatgacaggacaatttaattagcagacaaacatgttaaaacatgttatacatatgctcaagaatgtaaaggaaaatgtgaaaatggggagaaaaaatatatt

SEQ ID NO: 400366 - DNA, 657 bp, Homo sapiens
ccactacagtggctgtacttgcatctattttgcccttcagatttaaaaaagaagttctaacaggtttgcacacatgtccaaggcagaagcaaagagagaaagttgggagcataggtgaaacaatgaactggggtaaaaagcaaatccttaatcccaaggcaagtactccatttagtaaacaattaccaaacttaaaatatgaatttagaactctgtaggtgactgggatgctgaagtagaaacagagcaaaaagacaatccagactcgtttctcttgacagatatacaataaaatgttatgctgtaaacactcttgagaagtatgttcagggatatagcataagaaaggaagtcatttgggggtcagggaatgcttcattgaaaggcagtccttaaaataagtaacagcagatgagaatttgctaagcagacagtagaatattggcgggggtgaaaggaaagtgatggaacaaagatttctagtttgaattcacatagcctggctttggggaaaatagtcctttatttaaccttttttctttgaaattggtgattctctctgcttggagaagtttctgaaaggaattacaaatcatcaaaatgctgaaaagtaccctcgctgaaactgtaaataaaggcgaaacatttttcatgatg

SEQ ID NO: 400367 - DNA, 878 bp, Homo sapiens
taccttgaacatctgtaatgaaggtggtcatctccttactaatggatgaatgtcagttatctccagcttttgcaattatagcagtaaatgtagcaaatacaaagccatattgggcttgttgaaaatatctgtaagataaattccttgaaattaaaatgattacgttctcttctgtggatcttagctggcacattccccttacacacattttggcatccttgccttctttctgcctctcattttctgttcctactacttaatgccattttgcttccatcttctgtcactactgcctctacttccacttaagctgcagaattgagggtgggccttagacctggtatgtggaggagagaatgattaattatacctggttcatgctttagattgaaagagctacctttcaaagtcaagtttattgaggtataattaacctacggtgaagttcgcgtttttaaagcatccagaattttggcaaatttatacagccatgtaaccagtgccacaatcaagtaataggacatttctgtcaccccaaaattcctcccacctctttgtagtcaattttctacctgccaaccccgggtcttcacaactgctcatctgatttctagtgttacagttctgtcttctccagaatgtcatacaaatgagatcatataatatatacccctttgtgtctttagcttagcgtaatgcttttgagattcacccatgcttgcatgctgtaagtagttgatacttgtttattgctgatacttgtttattccattttatagatgtaccaaaacttgtttatcagtttaccacttgatggatatttcgattatttctggtttggggctaatgtgaataaagctgctgtaacaattcacata

SEQ ID NO: 400368 - DNA, 1829 bp, Homo sapiens
gagtggggacttttgtccctttttgtcagtgggaggctgggctgggagaggaggcaaggaacagcacactgtagaaatggagagtgaggaatgggagaggcccagagctcagtatgcaagctgtgtacagcggaggttgccggactgtctctgatgggctgctagtggggtggtgctggggaaggttgactcgctaaaagaaaggctgctgcagtcacatgttatagggtacatctgtgagaattagggaaaggaaattgctccgtgtcaatgcagtcttacccagggcacatggcttggggatgatgtatgaagtggactttagttccctgggtttagttcccttgttgtgcagtgcacggcttggacaaatacatgggtggccttgactaaaaggctttggttcaaccaggtgcttttctcatcgcagcttaactcctggcttcctaacactccccatgcgaggcagccccaattcacctctaaccctgggaggtgccaggaaacagagttggagccgcatctactgcttgacttctcaatgcaaacttaactattttaaagtgtacagttcagtggcattcaataaattcgcaatgtcgtgcagccaccacctctgtctagttccaatacgttttgttattgcctcaaaggaaaccccgtacccacgaggcagtcactccccattcctcctcctccagcacctggaaactactaatttgttttcttttcctataagtttgcctattccgaacattttgtataaacagaatcagaccagatgtgacctgttgcatcttgtttctcccgcttagcatagtggtggaagattcacccatggtgtagcatgcatcagtacttgactcctttttatggccttaggacaggccagggcatatgtatcccacattttaccacattttgtttatccatttatctgttgatggacccctgtgctgttcccatcctttggctgttgtgaatagtgctgctataaatatgcatttacaagtttttgtttgaacacctattttcagtcctttggggatacagagccaggagtggaactgctgagttacacagtaattcaacatttaactttttggaaaactgccaaactgttttccacgacatctgcaccattttacgttcctgtcaacaatgtgcaaaggtttccatttctccacctgtgtcaacacttgttattttccattttaaaacattatagccacccttgttagagtgaagtagaatctcattgtggtttttgatttgcatttccctgatgacaagtgacattatacatattttcatgtgctcattggccacttgtgtgtcttcttcaaagaaatgtctattcaagtcctttgcccatttttaaattggttgtttgtctttttttgttgagttgtaagtgctctttatatattctggaggctgactgacttttattcttctaagtcaaaggtgctttagcccaagtcctgtcactcaaaaagaaggctgggtgcagtggctcttgcctgtaatcccagcactttgataggctgagtcaggaggatgacttgagcccaggagtttgagaccatcctgggcaacagggtgagaccttatctctataaaaaatgtttaaaaaattagccagggacggtggcatactcctgtagtcccagctactccagagattgaggcatgaggattgcttgagcttggaaggtcgaagctgtggtgagctgttgattgcaccactgcactctagcctgcgtgacacaaccacactgtagcctgtctcaaagaaagaaagaaagaaaagaaagaaagagagagag

SEQ ID NO: 400369 - DNA, 145 bp, Homo sapiens
gtttaacttagtcttgaccaaaatgctaatttaaaactttacagcaagaaacttactttaaagcatgtctgctgttcatgtcagctgattgcaaaatcttctgtgggaaaattttcatgaagtattaaagtcctggggagcagag

SEQ ID NO: 400370 - DNA, 368 bp, Homo sapiens
tctcaccatgaatcacgtctgcagtgaagggttctgacatctagcaaggaactgacaagtaacccttttgtttttctctgtctcaacagtctggccaggtcacagggggacacagtgccaacaacatggatttttaaattagaatttgaggagctccccgcaggcatactggctcagttgcccacacagtccaagaacacccacctgaggaaggctttatggagctctctcattttgtttattccagttaatgaaagacaattcttacattcctaaaacaatgttcacacacatcagccatgatgtgatatgataaaggatggcttaaaaagctcccaccccattcgaatggtgggaatttaaatgca

SEQ ID NO: 400371 - DNA, 393 bp, Homo sapiens
cacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaa

SEQ ID NO: 400372 - DNA, 220 bp, Homo sapiens
gaatattaaaaagtgcatgtgcaaaatagtactggaatatattcacgtattttaatgttaattctatatctatctctaatgccagaattagtggtacttttctgaagaatacatcttcgttcaatgtggtcgtattcttaattttttctataatattgcttgtaatctttagagttatggtttcattttttgactattaaatttgaaattgttgacatca

SEQ ID NO: 400373 - DNA, 548 bp, Homo sapiens
gaactgatgcaataatggctttccaacccctaaggctaaacgcagcaccctaaggaaaggctcaggtgagaggaggttcaaggttaaaagtcattcaaggagtacccactgactatttataatgtttaactggtattgggcagactgtcatacctagggactatatggccaccatctgggtactaccagcaactgctttcacgtgaaaaaaagatttccagaagaaacgggaagaattccaagacagcattagaaagcgtctcaacagtaggcatagggattctgcggtagctctgtagagacttctgttataaccactctgatctttgcacatcaaaaatccaagataaatcctgataaaatgaccagttgatggttatacaaataggctctggggttctaggcttggatttaccatgattttactgtgcattcatgggaacatgactcaaccctcagagccaaatcccttaaggtccaagaaggagactttttctccaaaaggaattcttccaaaagagaagccaattcagtgctttgctctaaat

SEQ ID NO: 400374 - DNA, 479 bp, Homo sapiens
cagataatgtgtaaatgcattcaggagataaggagaattagaaacaaggacattttttgtgtatttcttaggaataaaatggtaccttctacacatctcaattattaaagtacaaatagtgattgaacgaaatttttagaagaaatgttttaattgaatcttcacactagaggttttaccattcaatcaattaggttctgagaaggatggattggtacatcttaaaagacttgtaagatagcgaaggataggcagtgctaatgaccaacagcaacactcagcaggactttgtggaccaaaaaacttcaagttagaattgtgggtaaaggctgggcatggtggccctcacctgtaatcccaacactttgggagcctgtggtaggagcatcacatgaggccaggagtttgaggtttaagttacctgcagtcataccactggactcctgcctggttaacagacgctgtctcttaaaacaaaa

SEQ ID NO: 400375 - DNA, 610 bp, Homo sapiens
cagagcgagaccttgtctcaaataaataaaatgcatttcttgaaagtagcctatttaacaaagaaatggaatcaatgtaggtgctcatcaatggtggattggatgaaggaaatgtgctacatacacagcatgaaatactacaccgccataaaaagaataaaatctagtcctttgcagcaacatggatgcagctggaggccattatcctaatcaaattaatacagaaacttttttactgcatgtgtttagaatctctgttaataaggggcatcaacttttaggattgttatgttctcttgatcaattgaccccttatcagtatggaattactatcttcatctatggtaatatttgttcgtctaaaaaccaatttttgtaatgctaatgtagataatccagctttcttttgattactgttagcatgctatatattttagtttatgtttttatattaaaagtgtatttctttggagcagcatgtagatgtttgattttttaaaatcaaatctgacaatctctgtcatttatatgagtttaaaccatttacatttaatgagatttatgacatagttaaatttaaatatattatctttgtactttctgtgtgttt

SEQ ID NO: 400376 - DNA, 468 bp, Homo sapiens
ctccccggaaggtgcagtgctaattggctccccagagactccagtaagcatcttgtcagcctcagcaccagctccagcctggggggtctcgctcagaagcaaagtcactgagtgacctgtcctcctgacacccacaagactaaaatgatctctcagaggggacctcacagaaaccagcaccttgtccatgccagctgggtatctgagagaaactgctttgttttcctgaagtcatttgaaacagcgtgcagagacatttaaactcggcgggaaataggagaagcccaccttgacccttctaattctctggccccaggtgccttattaacaagagacagtatcagacacaccagacaaaagccctcctgagcccaaagagcccaaatgtctggaagctctctgctgagatgccaaaatgcatgcctttctgataaagagacagagacagatgaggtaccatgatatgga

SEQ ID NO: 400377 - DNA, 301 bp, Homo sapiens
ccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaa

SEQ ID NO: 400378 - DNA, 404 bp, Homo sapiens
catgttgtgaagatggaaattttgaaagaagtgtaaatatagtgtaaattataggacgtcaagtcaaggttatgaaacaaactatttttttatgtaaataaatgtgttaaaaagtaagcctgggccaggcacagtggctcacacctgtaatcccagcactttgtgaggccaaagtgggtggatcacccgagctaaggagtttgagaccagcctgactaacatggagaagccccgtctctactaaaaatacaaatttagccggacatggtggcgcatgcctgtaatcccagctacacaggaagctgaggcaggagaattgcttgaacccaggaagcggaggttgcagtgagccgagatcacaccattgcattccatcctgggcgactgagtgagactctgtctca

SEQ ID NO: 400379 - DNA, 467 bp, Homo sapiens
agcttgacgttggtggcctctggtcagcctcatggttgggactgcgtggaaatgctagacctgagagacctcatttcccaagcagtcttagagagactcaaaacaaaaaatggtctccgggtcccaccgtggtgtgtggccgctgtgcccgcagaggccaggtgtccataggctgagtccccacgtggacctgctaggtgggtagaaaggagttgaagatgttgtgctgttggttggaggagcttggaggtgtctgggaacattggatgttactcatatggaatcagcagaattagtagagccaagaacagacggcagtgccacaccccatggctggactgaggctgctccaatgatggcaggttgtatctgcgggcatctccaatttgctcagggaactctttccagattggtcagtggtataaatgaaggattaggaaattgggtaaaaagccagggaggaggga

SEQ ID NO: 400380 - DNA, 428 bp, Homo sapiens
cacattctgatcgattaagaactgtgaaattcagcagccagaatgattttggctgcatctagattgtgtttgtgctctttattccccagtgaagattaattttagtttgtagggtagaaatagtgcagattcttgggcttgagattttcagtcttcatgttcctaaagaccaaaggccaggaccagattctgcagtaattttcttttgtccccagctttgaaaactcaaattcctgtatctttccttgtcagctttttgaagcagatacaatctcctagttggagcaagggaaagaatataaaaagaattttccaatacatgtgttcaagtgagaaccagacacataggggtcattacaggtgtagaaggtccatttgaaaaaatccgcatagaagatgccacattttttcttcatttcccacctcct

SEQ ID NO: 400381 - DNA, 622 bp, Homo sapiens
gtgccttgtgtttattttagcctctctgagcttccccaccatccacacagggctcctcttcctcattcccacatggtgacatgctgggttccttctttctccaagacttgagtcagtggctgaacacgcactctcagggatgctggccagggactgaggcactgcctgtttctgtgttgattggtcctgggcatcagggttcatttgtgggagacccgaccacttcagggagttttatcctgtaattctttccagttctttcttcttgtcctgtgactgctttttctcctcccagttcctcagatttgttttcgtccacagcagtactttatggcggtttggaaggccattgactctccaagcacctgtgccacctgagtcgattttctctttcccatcccctctgccctggagattgtattcaacttccgcttgttttcattcagcatttcctgagtgcttgctctgatatatgttcagggcagcctccgggaatagcagactgagactccatccttatcctctgggggccttcaggccaacaggaaacaggggtcaattggctcacctctttatctctctgtgtggagagagagagcaaagagagaagaggcttcctgga

SEQ ID NO: 400382 - DNA, 421 bp, Homo sapiens
ttacatgtagacatataggttagaaggtatataagcactggaaaactttctaattttgagttagtctggtgatattttccaggtcttctccctgtaaccagttacccaaataaaaattccctcctttcccagttcatctgcatgttgttattgggccactggaataagcagcccgaccctcagtttggtctgggaacatttctgctgaggaggcaactactcttaccagttgggtatattttcttccaggcttttcagggcagttatcggtgtagaatcctgacagattgctctcaaggcttcaccactccacacttccaacagagaatggcgtgtgccttccccatcactggttttttattgtcaataaagtgaggcaaaattttaaatctgatgaaattctgtgtctgtgtcagagatg

SEQ ID NO: 400383 - DNA, 500 bp, Homo sapiens
actttttacattaatgggccaagtatagaatattttgagattcagtaagaaatattttaatggtggcaggccctggtccccttcattctgtcagactgcccagatactgcttccttcttgtccgttttgtttaaactttccattcatatttttttcttcctgaaatgtttctttattttgaggaatgcccccaaagcttataacctgtcagtgtgcattattttaccatgaaggtcaaatgctttattttctacctttctcttccccatcctattatcccttagcattgaaaacatttttatagtactatttttgttattgtttcccagtggtttttgaggaataatggacctgtttgaggaaatgtgtgttgcctgatctctagaaaaatgtggttacctaagacattttgcatgtgatttggatatgatttcaggggcttatggacccactaagtcccatccatggactcctggttaatggcctaaatgaaaaaaaaa

SEQ ID NO: 400384 - DNA, 405 bp, Homo sapiens
ctttccacctagagctaatagctaaaaatctccaatctcactctctttgtcttctattacgcattgctaacttaccctcaaactctagcagggggttctgtcttctctcagcattcaaacccaccaggcattctagcagcaccatgtttttctgggggacattcctctcagaacccatttccctgcctcaatctagctgactacttcctctgggtacagcacacctgtaatcctgggatctccttcctaatcatcctggagattcccagcacctcattcttgagttaggtcatctgttcttacatcccatatcttcctatttttttaatctgtgaccttattttaaaaaaaaaaagcccccttttgtggctttctgagaaaagatggggagtagaggtgttgaga

SEQ ID NO: 400385 - DNA, 462 bp, Homo sapiens
catgtcaggtatgaaaatagcctgtcctgtggattctgtcttctcagatgaagtgaaagtctttcatggtggttcgtgcaccaggagaggaaacaaacagcaatagggatttctccctgaaaagccacttaggaaaaattctattacccttttaccgtaagagaagagttgtagagtctacctgcagtttcacaatccacccactctggacctcaatttgtggcaaaaagaacagaagactttcttccgcttatgtagtttgggcaaactaaatgtctaaaaacagacaattagaaaaaggaattagaacagacaattagaaaaagtaattatactcatccataaaatagaatgttgtttagccggtatagtaatggaccatctaaaaatgtgggaagatgttaaaattagaatgctgaatgaaaagtataaaactgtgtctaatacggccatatttataca

SEQ ID NO: 400386 - DNA, 427 bp, Homo sapiens
tggagcagcagctacaagaggaggctgagcacctgagggaggagctggagagtctggcaggacagctccaagcccaggagcacctggaagctgccagccagagaaccagcagctacaggcccagctgagcctcatggctctccctgaggaaggtacgggagatcactcagaggaagaggagggagcccaggaggaaggggggactgttagcagataggagtgaggagtttagaacagctggtcactatgccgaccgggtttctgcgttaagttcggcatcaaaacggtgacctgggagtagaggggccaccaggttgcctaaggatgggtgaactggcccaagtcagaaatgaagcaggtcagaactcccctgccgggcagtagtggaactgagcttgggcaacatagtgcgactttggttctcaaa

SEQ ID NO: 400387 - DNA, 904 bp, Homo sapiens
agtttaacccactttactgaaccaattggaggcatccagcagaaactccttcaacattattttcttcatatgggctctcatttctctgcctcattgctgataaagtaccctcctttatcttactgattccactttctctcctgggccttgctttatgatttatttgtattctgcctcctttgagatatcctttcatattgattattttccctctaccttaaaaaaacctgaaaaatatctatgagcagtcttatagtaattggtgatctcagtgagagccatttcaggagagaaatgagtacagattccagaaggcagaaagctgataactgagtaggaaatatggaagttgaaaatgatgagggcagacttctttaataaaggcttacgatgaaatgagtaggggctgtatgatcaaaggattgtttgtttgttttttttaagagattgggtagatttaaacacgattacatgctttaaaaaagagaaaaaagggagaggtttgtagagtaaataccccagagtggagattcaagggattagcctcaaatgcctttatatacagactgtatccatctttataagcccagctgaaatgacacctctctgaaactccttttgattggctcagaagcaagtttttctctgatttcctgtagcagcttatacatctctcatggcatttaacacatattgtcttgaataacagtgtagttattatgagctttactgtctgggtttgattcctggcttcaccacctactagctgtgtgattttgggcaaattgcttattctctctgtactcagtttccttatctataacatggggataatattagtagctacatcgttgttatgaggatcaatatctgtaaagctcttagaacatgcatttttcttcta

SEQ ID NO: 400388 - DNA, 515 bp, Homo sapiens
cagtgtgatgctggattctgtgtcctcattagtctaacgagtctactctgttgcccacatcacctcccattaggaccactatgcccttttaaaaagtggtctttataagatgtaagtattatgacacccttctgcatacaactattcaatggcttttgattagccttaggataaaaatcccgtcctgccgcaccgacttgtccatcttgtgggtagccacttgttactacctctctcagtgtccttcccagacatgctgcttccactcctctcccctcagatccccgttttgcttagttacttcctcctcatctttcaggtctcaaagtagttgtcccttcactgaatgcaccgacaacctggcccagtaaagttactttgtcgtctgcgcccaaataatcctacccttccatctgctacattccttaaatctgcaatcccttgttcaaagcctgcaaaagagcatgagctccttgaagcaaagacagtattagtcatttttaatgtaaagtata

SEQ ID NO: 400389 - DNA, 473 bp, Homo sapiens
cctttgcacacgggaatgcctgtgctgatgcatactcactttggcacctgtaaaatctcatcactcaacgaaggtcctcaggcagaagggcgagctggcctggggacacacggacattacaggagatatattctcagtacggatttaatttagataacacattttatttaaaaacaaaacaaaacacatgacgttcaaatgccccaacaaaactaaagtgatgaactggagtcagctttctgatgatggtgagatggttctgtcggccacactctcccggttctattatcaaattctttgccatatgtttcatgtaaggcatgttttcttccattagtatagtttattaatgtttaatattttctagtgaattatcatgaggttttttttgtttttctgctttggatgaaagaaacatctgttatgcatgtcaaaaatagagagacattaaacttctccaaaccccttaaaaa

SEQ ID NO: 400390 - DNA, 1272 bp, Homo sapiens
  misc_feature (152)..(152): n is a, c, g, or t
  misc_feature (395)..(395): n is a, c, g, or t
  misc_feature (1120)..(1120): n is a, c, g, or t
  misc_feature (1123)..(1123): n is a, c, g, or t
  misc_feature (1125)..(1125): n is a, c, g, or t
agcggagggggcgtcgtctccctggtgcgcatgctcgcccccgctgcgggctagctgttgtgtttttttttttcccccgggcggcccggcggctgcgtactggctgtgggatgggaagtgaagccccagcgagcggctgcagcggggccggnggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttntgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtaactaaaggcagatcttctaaaaaaggaacagaaaatggtgtgaatggaacattaacttcaaatgtancanantctccccggaataaaaaagagaaatcttcataatgaattataaactaattgattaatgtccccaaagaaatctgctttttactatatctttcagcattagagatttttctgttcttgaaaatacagtctgtgctctttgaaaaaaaa

SEQ ID NO: 400391 - DNA, 1485 bp, Homo sapiens
  misc_feature (152)..(152): n is a, c, g, or t
  misc_feature (395)..(395): n is a, c, g, or t
  misc_feature (1189)..(1189): n is a, c, g, or t
  misc_feature (1204)..(1204): n is a, c, g, or t
  misc_feature (1214)..(1214): n is a, c, g, or t
  misc_feature (1218)..(1218): n is a, c, g, or t
  misc_feature (1223)..(1223): n is a, c, g, or t
  misc_feature (1244)..(1244): n is a, c, g, or t
  misc_feature (1252)..(1252): n is a, c, g, or t
  misc_feature (1255)..(1255): n is a, c, g, or t
  misc_feature (1262)..(1262): n is a, c, g, or t
  misc_feature (1264)..(1264): n is a, c, g, or t
  misc_feature (1333)..(1333): n is a, c, g, or t
  misc_feature (1336)..(1336): n is a, c, g, or t
  misc_feature (1338)..(1338): n is a, c, g, or t
agcggagggggcgtcgtctccctggtgcgcatgctcgcccccgctgcgggctagctgttgtgtttttttttttcccccgggcggcccggcggctgcgtactggctgtgggatgggaagtgaagccccagcgagcggctgcagcggggccggnggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttntgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctgggcatccatttgcgttactcaggcatttatgatgtggaanttcattaattttcancttcgaaggngganggaanattctgcttttcaggcaccanttgtgaanaanaaaccancngtactaaaggcagatcttctaaaaaaggaacagaaaatggtgtgaatggaacattaacttcaaatgtancanantctccccggaataaaaaagagaaatcttcataatgaattataaactaattgattaatgtccccaaagaaatctgctttttactatatctttcagcattagagatttttctgttcttgaaaatacagtctgtgctctttgaaaaaaaa

SEQ ID NO: 400392 - DNA, 1220 bp, Homo sapiens
caaactcctgagctcaagcgaaccacctgactcgttctcaaagtgttaagattagaggtgtgacccaccttgcccagcctgtttttttaaaggtgtcactttttgagcatctcacatactaggcaattcgcatatcccatttagtcctcacagaggcgtcatgagggatgtgtcattgtaacaatttataatgagggaatagacttagaagggttaagttactggtgcccaaggtcatagagacataatcaaattggtctgaattccaatgtatgactaccacacctgtaacctgctatgctactctgtctccctaaaacccataaacttcttaaatctttacagtgatattccttcattttcccaatgcacttttataagtctgcaaaagtacgtaatattaacaaagtgtaaaactatgcccactctgcttataaaagcaggaggtagaaagacaggagtattaggaaactctgggcaatcaaaacattctatctatgaagttctggttaatgccaactcaccggtaatgacaggtagtaatctgagaacaagcatagataattggttcattttcttgctgtcactatggtagctcacattaggaagataacttggttcaggggcaggagcactggaggcggggcacctgcaggtcttcattttaatactcacataatggtgaaaattgtttgaaaatatttggaattaacaccaacactaaagtattcttgctgtcttggaaagggaagtcattgtcttgaggaatcttgtgtaagttcaatttggattcagagagctaatttctggaaagctgtattaaatgctaaggcttcagcattccactgggtgtgccgtcatctaacataaaataataccattttgtgagaagcgtatggtaaagagagaaataatcgagttgtagcacccacagattgagatcatcctgacactcagcagtgatgctgcaacgggataattgagggctaggcatgggggaagctctcgcaacttttgaaagctattatgaattttttagttttctcttgtagattcttgatttatctgcctcttgcttgtttttctatctcgaaagtatgtctgagaaatgctgttttagagagcaggtccttaattttctattgaattttgacatggagcccttcctcaattaatataaaatatacctactttcactgcccagttcttgcaatacaaaa

SEQ ID NO: 400393 - DNA, 222 bp, Homo sapiens
ctgaggacgatatcttcagctgagacttaaaggagaaggagccagtcacatagttcttgttttcctcgatcctggacaagatgggttgcaactgaaaaatcagatttagtgggtgaagtcacacaaaactgaagaccctctgcctggtgtacctgtggcttggctcgaggcactcagtctgtgccccgagtcctacgcaggaataggaggtctgaattgtgt

SEQ ID NO: 400394 - DNA, 1797 bp, Homo sapiens
acagtgtctttgggcgtcttcttgactgaatctgactccattggaggctgtgatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtcctcatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagaactcctgtgggcctctgctgctcagccatcccccggaagcctcgcccttgtcctggactccggtgcctcctggcccttgggtccctggacactggctgcctccaggcttctccatgccaccaccagtggtgtgccgcctgctgtaccaagaacctgctgtctctctgcctcccttccctggctttgaccctggcacctccctccagctgcccactcatgggcccttcaccacctgcccaggatctcacccagtactgacagctcctctttctggagagccccaagggccccctagccagccccgcacacactcaactctgatactccagccctgtggcaccccagaccctcttcagctacagccacaggcctctggagcctcgtgcctggcccggacatctggtccctcagagtggcagctgcagcaagaggcagctgaagccctcgtggggctgaaagattcatcccaggctcctcgtgtgaccccttctgtgccccccaaccctgcctggatctccctgcttcacccctgtggcccaccagctcctgctggaggaagaggattccagcctgttggcccctgtcttcgacccagcccagccccctctgttgctctgcatattggccgtctggggtccatctccctcctgagctagaaacccagagatggaggctgtcttgctatggcagggaggtgacagcctgctggcactgtatatttagtgtcttacttaaggatttatgcatggaatttaatgtagtacaagcttcgggcttttttgtttgtttgtttgtttgtttgtttaagctttcaggtgcttcattagctttcagttcctttggtagtgtgggcatttccttggctgacagtggatattcttgtacccttcttgggtcctgggatctcttgaaatccccaataaagagagagttgtgctatttaagctgaccagtatctataaacgtgtttgcatgagtttacatcccaggattccatgattctgtaaatgcctatgcattcatgtctgtctccatgcatgtgaaaacaggagagtgttttcattttgtgtctaggtttgtgtgagtaagcaagaaataaacctttgttgttgtaagccactgagatttggagagtgttaccacagcctaacctagtctatcctgactgacagaaaggacttgttcatttcgcttctcaaagtgaaaaatctgttatccaatagctaccatagatgaaaacaaacttggatttttttctttgtccaaataaaaaaaaatgatgtaaagaaataa

SEQ ID NO: 400395 - DNA, 1111 bp, Homo sapiens
ggtacccgttcgtacgagaatcgctgtcctctccttgctcgagatccattgtgctctagatctcacccagtactgacagctcctctttctggagagccccaagggccccctagccagccccgcacacactcaactctgatactccagccctgtggcaccccagaccctcttcagctacagccacaggcctctggagcctcgtgcctggcccggacatctggtccctcagagtggcagctgcagcaagaggcagctgaagccctcgtggggctgaaagattcatcccaggctcctcgtgtgaccccttctgtgccccccaaccctgcctggatctccctgcttcacccctgtggcccaccagctcctgctggaggaagaggattccagcctgttggcccctgtcttcgacccagcccagccccctctgttgctctgcatattggccgtctggggtccatctccctcctgagctagaaacccagagatggaggctgtcttgctatggcagggaggtgacagcctgctggcactgtatatttagtgtcttacttaaggatttatgcatggaatttaatgtagtacaagcttcgggcttttttgtttgtttgtttgtttgtttgtttaagctttcaggtgcttcattagctttcagttcctttggtagtgtgggcatttccttggctgacagtggatattcttgtacccttcttgggtcctgggatctcttgaaatccccaataaagagagagttgtgctatttaagctgaccagtatctataaacgtgtttgcatgagtttacatcccaggattccatgattctgtaaatgcctatgcattcatgtctgtctccatgcatgtgaaaacaggagagtgttttcattttgtgtctaggtttgtgtgagtaagcaagaaataaacctttgttgttgtaagccactgagatttggagagtgttaccacagcctaacctagtctatcctgactgacagaaaggacttgttcatttcgcttctcaaagtgaaaaatctgttatccaatagctaccatagatgaaaacaaacttggatttttttctttgtccaaataaaaaaaaatgatgtaaagaaataa

SEQ ID NO: 400396 - DNA, 434 bp, Homo sapiens
tttataatacatattttccatgaaaatttagaagaacacttatatagatgaatgatagattatcaaagttttcccagatttgtcaggctttgttcttcacggttttcaaatgaaagggcctggagaaaccgaagaactaaaagggttgcagaaagagtcctaaggggaaagaaaaactgatatactcacatcttcgacctaggcaacaaaagttatgagtcaagatatttggtcacataactaaagataacttaggttttatgacatttttgttttttgttttgtttttgtcagttaaaatagggaaattttaactgaaatatcaatgaacagtcccattccctatcctcaccattggtacagcggatcttgtttttcttaatgtggtacatattaataaaatttatgagacctaaggtctactgcatttgaaa

SEQ ID NO: 400397 - DNA, 407 bp, Homo sapiens
acatgtcctcaaaatacagattaatatgtatgtatgcatatgaagatgtgggaggagaatatgaaccaagggttacagtggtgatctctgggtggtgacagagatattttattttttgttttggctggttccatattctatgatgctcatgaagtgcttttgtaataagaaaatattatttaaaatttaaaaataattttctttgctatcggtaagtgaatagcagatttttaggaggcctaataaatccataaatccataaatgaaatctccagttattaggctcctcaaggacagggtctgcagtggagttggctctatgttcttgatatttaccagaatgcctagcagctaattcaacaaattaatacatttaatgcaagagaataaatggaagaactagatct

SEQ ID NO: 400398 - DNA, 446 bp, Homo sapiens
ttctccaaatgaactaggaaactagtttctggaagtgattacgtttcccactcctgccttccaccagaagacctcatcccattccactcttcccctctttcaatccatgctgcctacatgtggggatagtttaaatttgacaaactaaagctaattcctgctataagagtaataactgctcattttccataactcattcttaaagttttagtaatgtaaaagttatttttttgcagtaagttataatgatagaagcttacatgttttttcatgcctcatctgtttccccttaaaactataattatcagtaaagtcctgtggtatttttcaatttgtaagaaactaggctatatatacattgggaaaaacagccttcatttgtcaatgcactagtgttccaaaggtttctggtaactgtgtgctattgctttttgttgacttgcaaa

SEQ ID NO: 400399 - DNA, 528 bp, Homo sapiens
agccaaggcctgaagacctttcctgcaaggtcgcagaggaagaggcagaagaaggaccagaacccagctcccctgactccctatccagtgctcttctcatagattacattgcttcagcatccacctggctattgctccatccaggggttacaggagtcactgactgttttggttgcttcttggttggaggatgttgtgcctcaccgatgagagccggaagcaaaggtaccagttcttagaggaagcataggaatgtgtcccttcctgctcgggtctctcaactgaactcaacccttccttgattgattgacaagcatgttatctctcataatccctgcccggtaagggctgatgtccccattttacagatgaggatattggagctcagagaagtgaaatgattgctgaaggtcacacagcctggcttcaagcctctcgggctccaaaaggcatcttctgttctctccgtcaggaagcctcttttggatgattaactgagattaaaaatgaaaagacacatgaaagaaa

SEQ ID NO: 400400 - DNA, 452 bp, Homo sapiens
ttcgttgcccccctttttggtttttggctctgtgcccccccccaaaaaaaaaaaaaaaaaaaaaaaaaaaaaaaaaaaaaaaaaaaaaagccaatggtccctccgcttggaggatgttgtgcctcccccgatgagagccggaagcaaaggtaccagttcttagaggaagcataggaatgtgtcccttcctgctcgggtctctcaactgaactcaacccttccttgattgattgacaagcatgttatctctcataatccctgcccggtaagggctgatgtccccattttacagatgaggatattggagctcagagaagtgaaatgattgctgaaggtcacacagcctggcttcaagcctctcgggctccaaaaggcatcttctgttctctccgtcaggaagcctcttttggatgattaactgagattaaaaatgaaaagacacatgaaagaaa

SEQ ID NO: 400401 - DNA, 457 bp, Homo sapiens
ttgcaaaactgaacttctatacccaatgaacaactctccattttccactccctaccaccccgttaaccaccattctgttttctgtttctattaatttgactcctttagataactaatataagtggaatcatatggtatttgcctttgtatgactagcttatttgatttagtgtattgctgtcaagattcatccatgttgtagcatgtgtctgaatttccttcctttttaaaggttgaataatattccattttatgtatgtgtgtgaaccccacacaccacacacacatatagcacattttgtttattcatccattagtggacatttggattgcttccacctctttaaatgaattttttcttactgccatttggtgggtacatggagaactcacacctaatttaaaaacccatcccactggttttccactacacaggattccctactaagctggcttg

SEQ ID NO: 400402 - DNA, 434 bp, Homo sapiens
tgcacccccactgtatgtttttcttgccacttggttatgtcttaaaatcagtgtgtggaatctgtaaatattatggaccccattagggcagaaaaggtgagtggtcgcattttgcccctctgtgagaggctccttagaactccttgcctggccggcacggtggctcacgcctataatcccagcactttgggaggccaaggcgggcagatcacgaggtcaggagatcgagaccatcctggctaacacggtgaaaccccgtctctactaaaaatacaaaaaatttagccaggcgtggtggcgggtgcctgtagtcccagctactcgggaggctgaggcaggagaatggtgtgaacccagcaggcagagcttgcagtgagccgagatcacaccactgcactccggcctgggcgacagagtgagactccgtctcaaaa

SEQ ID NO: 400403 - DNA, 118 bp, Homo sapiens
gcagcactataatatgtaattataaattatgtacctataccccatgtttattgcagagatacctacacccccatgcttattgcagcattataattaataaactatgtacctgcacccc

SEQ ID NO: 400404 - DNA, 394 bp, Homo sapiens
cgaggggcgcgccacgaacccagcgggaatccctgcgcttcccggcaccgtcgggctgaaatcggggttcctagcgttggcggcctcgggctgggacctccccactcccggggctccgcagggcgcgcacgtggcgctcgggggtcaccgttgcagccgctttcccgaggaggcccggattgaaaacttctttaaaaaaaaaacttaaaaaaaaaattccgtcgccctgggcgcagccttaggtacctggtgccgctcgtggggtcccgacgcccctacccccgggtccggaggagcctgcgccgggccgggacccccagggcacaagaggccgggggacccctgcggtcgcgcgcgcgcgagggggcgggggcgggggggacacgagtttatt

SEQ ID NO: 400405 - DNA, 443 bp, Homo sapiens
gataagaaagatgctgttgatgtctaattgattttatgtcacttatgtgacaatatgtttgactttgacgtaatcagttatgatttagtaaaataacagcaattttttcttccatggcacgaatagttttcttcctgaaatttcctgcattgtgaatttggggtttcactatgttttcctttgctttcttttatgccatctccttttttaaaaaaattgtggtataatgtatagtaaaatgaacagatcagttttgacagttatgtatatttgtataatccatacccctgttaagacaggttacattgccatcaccccccaaaggatgtttattcccgataaactacccccataatcaacaactgtttggattttatcaccatagactagctttgcttattctagaatttcaaataaatgaagtcatgcattatgaactccct

SEQ ID NO: 400406 - DNA, 418 bp, Homo sapiens
agctaatttttttgtatttttagtagagatggggtttcactgtgttagccaggatggtctcgatctcctgacctcgtgatctgcccgctcggcctcccaaagtgctgggattacaggcgtgagccaccatgcctggtgccttggacacattttgaagttagctgattatcacacttaggaatgtaagacctagatttgagtcctatcttggccttttgctactatgggacctggagactgaattcatcatatgtaaaataggatcattgctttttgcttttttgtttcatgcagtgaagaaaaaaagatgagatagtacatgtgaaaatgctctgtaaatggaaaaagtatataaactcataagatatgctgtcagagttgggttagattcctgattctgccacttactacctgggta

SEQ ID NO: 400407 - DNA, 605 bp, Homo sapiens
tcacccctgtggagatagcttcagtgtttcccagtgacctagaagcaaagtccatctgttggcaagcatttattgagcatctattattatgtgctaggggctggggagcccaagatgaaccaggcataggcccagccttcaatcagcctggcccatatgctgccttggcctggcattcacatttccacctgctcctcctgcctgctacaccgacccaccactgcctcaagcagcctacatccacagcgggatgcctgcactgctgcttccgcgtgtgctggcctgttggccctgtgtgtgtagtatcctggccccgtcaagagcttgtgctgtcttcagtgccctgaagtcagcccctctgcatgcacgcccttctgcagccctctggcctccgtggccaggtggcgagtcctgtttctgtcctgggttaactgaagccttggcagctgcccttgctgcctcatggggtgttttttggcctctatccctctctccctccactccaccctccctttttgctaccgcctgtctcttctggtttttgctattgcctggaaggtaggggacgtcacggtgctttgtgcagtagagtagccctgattcca

SEQ ID NO: 400408 - DNA, 374 bp, Homo sapiens
acacaccctcggctccagccctgagcccaggcccggatgcagttccttcccctgccccgtcacgcactgtgtgtggcttttggacaatcaaggggagctaggaaggagcttctggacgtactcagaacaagtggatgccggggtgcccacagcacagaaagaaaaagcaaaacaaaacaacgcagtgtttggccctttgctatcatttcatcacagcatcccccatcgccacttctccatggtctcactttatgctgtttaggttacctgcggtcaccctcggttcaagaataagtgagtacagcacaataagacattttgagagacagaggaaccatattctcataacttttattacagtatattgttacgac

SEQ ID NO: 400409 - DNA, 433 bp, Homo sapiens
tgagacagagtcttgctctgtcgcccaggctagagtgcaaatgcacagtctaggctcactgcaacctccacctcccaggttcaagtgattctcctgcctcagcctcccaagtagctgggactacaggtgcatgccatcacaccaggctaatttttgtatttttagtagagatggggtttcaccatgttggccaggctggtctcaaacccctgacctcatgatccactcgcctcggcctcccaaagtgctaggattacaggcttaagccaccacatctggcctgagctagcatccctaacgagttcccaagcgatgctgaggctgctggtctggggaccacacttttagatctctggatcagattatttcagggttcctttccagtttaaacagtctaagattccccagtaacatccaacagatgcagcactca

SEQ ID NO: 400410 - DNA, 468 bp, Homo sapiens
ataatgacattgtgttttcattcggttgtgcagtggggctttgaaactgtgggaaattgagagacaggcccttgttaggggaaacaaaaatggtttctaatttcaaggttgaatatgtttcttttcataaaaatacctcatcatttctaatagtctgaatgacagtcttatttctcttcattggtaggtaaaacctaacgttttctagacaataaaaagcagtctgagagatatggatgacatatttaaaaatactaacatctgaaaatatatcattttatagatttgactcgggaatcatgtaagtttcttctacaatgataaaaagtcaaaaagaaaatgaaaattaattctttaaaactgaaaggaaaatgaaacaaatgaacctaactgtgttggcttagtgacttaaccacatatatgtgactttaagcacagcaatttgactgtacaaaataacaataaaaa

SEQ ID NO: 400411 - DNA, 415 bp, Homo sapiens
aactttcttttttgttgattcattgaaggcatccctaaaagctcatttttatcaaattcaaaaataagaattgtagccaggtgtggctcacgtcaaaatcctacttcgggaggtggaggcaagagaatcacttgagcccaggagttcaagcccagactgggcaataagtgagaccctgtctctattaaaaacaaacaaacaaaaacaactaattgcatgctaatgccaccacttatccactcaagaaaaggcaactctacttgtaagctcgtaggctatgcataaagcaatcacaggttgttagtaaagagtacctaaaactaaggctagacagaaccattagccctccacagaggttgaatcttaaattttgtgaagataaaaattgcttcccattccaaatcaacatttatta

SEQ ID NO: 400412 - DNA, 386 bp, Homo sapiens
aaaagttattaatgataataacaaaaatttaagtacctcagaacaaatctaacagaacttatgcaagacctaaataaactaaaattgtattgtttaatatgctcaggtcaattgttctcaaaattttggtttcagaatccctttatactcttaaaaattaccagcctgtaaaagcctgtaatcccagcactttgggaggctgaggtggatggatcacctgaggtcaggagttcaagaccagcctggccaacatggtgaaaccccatctctactaaaactacaaaaattagctgggcatggtagtaggcacctgtaatcccaactacttgggaggctgaagcaggagagaatcgcttgaacccaggagatggaggttgcagtgaacc

SEQ ID NO: 400413 - DNA, 409 bp, Homo sapiens
gcagaagttcctaccatgatgcctagatctctggatgtcatagataatgcacaagcggatttgaatccaatccatgtcaatagatttatttgaaaatcctaccgatagtgacagagacctgttcatgctcagcatgtagaggaagtgggtggagttaataaacaggctatccatagatgtgagtggaaacaaagggaaatacatatggaacacacaacgagtagaaaggaaaaccagggaggcagaccagggcaatgctctctcccctgcctgagggatttcctcgcctctacttgctgctttctgtgccttccaccacagttatctctgcttcttccacttccgaatgcctaaaaatggccatttcagcacccaagaataaatgaatcttagtccaatttccccaaga

SEQ ID NO: 400414 - DNA, 691 bp, Homo sapiens
ggcatacacatagaatcctgtcacatccaggtagaacctacaactactcttcagtttcctccaagagtttcttatgaaattagctacaagtaatcaataactagctagagaacacaagaattaaactctctttttatctcccctggctccagcatttacctagggctcactcagttcctagcacagtacatacacataggaaagtatgtcaataaacaagtgctgagctaaagtgacagtgtttaagtttccaaccataagcagttcacataaaagacttatgggccagcaaactactactgaagaaaaaataatggcatgtcagagacacagttaaggataaagatatttatcttgccttgaaggagatttcagttttacctgagtgacctttctataaactaaaagataatctcctttgttgggaaggcataggggtcaggaagattactgaattctctcagtcactaagctcttataattatcaaagaaggtgcctgctgaacacaaaataaaggccccacatgtgacaggcaggcattcgttaacttatttcactagtaaagaacaaccaccagtaacagaataaatgaacagaagtccatctaggcataacttaatactagatgctggccttagatatcatctttactcaaattaaagggcattaccaaccaagaataattaattc

SEQ ID NO: 400415 - DNA, 499 bp, Homo sapiens
ctttttggggcctcattttttttttaatctcatgaggtgtaaggaatacaatgagttaatacttacagaattcttagaatgataccagcacactctaagtcttcagtaaatgttaatgggcaatattgattactctgtcacttgaagcactttacatttatctcatttaatttcttataacagccctttgtggtgggtgctgcttttttttctcttcaatagatcaacatatgggggctctgagaagagaagcagcttaccctaaagtcacagagctagtaaatggtggagtctgacttgagatccaagaagggagcttctgggatctttggctctaagctacaatgttattctaggggaatgtactttcttatgagagaaaaggacaataaataagttaattgaattttcggattgtcgtcagtggagctgaaatagggcaacatggtattaattagctactctggacatagaattgagcttggcaagcagagcaggc

SEQ ID NO: 400416 - DNA, 666 bp, Homo sapiens
cggtacccggtgtttatcgatgccacatttctctggctggaaccctgagagaaatgtggctggtttcccagagagttgggaaaggttgttttgaagccgtgggtagaagtcttaatgttgttctaagtgtatctctggattctattttgctctttttcttcttgtcatttcagatattgaggaaacagagcaggcaatttcaaatttctctttcaagtaggtaatcaaataagcaagtgtgttcagaacaattaaccttcagtaataatacctttcatttttgtggtggtacagtttacaaagcactttctgttgcactctctgtagcacgtaagctatgaccaggccaccctccttctgatttgtatctgcaaatgtctgggacgcagctaagaaagcattgagagtctaaagatcctgggtacaggcccggctccatcaactaactcgatttttatggtgtaagacaaatctctgggtctcattttctcatcagcaaagtaagtttggactaatgtctgcttccaactccaaaattctatcattttaagtctagtttatcttcctctaaaatatctgaatatatagaataataaacagaggtgttttgctttgaaaaaaaaacaatacatctaccatattattttcttataaataaaaaaaaaa

SEQ ID NO: 400417 - DNA, 550 bp, Homo sapiens
tctaaaaattttataatagcctattatgtacactttcgtcccagttctaaattcagagactatcttagacaaaagctcagtgatgagatgacaaggtgttagtcattattaacctactatagtatctaatagtataaagtgaacaaagcttaagattcaggttctgtagaagtatgtagttaaacgattggttttttttggatttcttccagaatcacaggaagatgaaaaggttctgaagcatttacaattttataagctttcttcggggtaaaacttatgtttaaaacttgccatgcaggatgtcttgcagccccaccacaaagaagattcagtggagctgaacaagctcactaccaagccactgaaaagaggaaagaaagtccatctgagatcaaaggtcgcacttcccatttttttcaagttctgcaaaggtgatctgtttccctttagtgcacaggaaataagtgagatgttctctaaaagcctttacctgtttcaccttatactgtaatcactaaatccagaagactaacgcaaactcatactt

SEQ ID NO: 400418 - DNA, 444 bp, Homo sapiens
attttctgataaattgctttgtaaaaatgctttttgaggctttcataatgtttttcaaaatcagataacatacctaaaggaagatatgaatgtcttttttaaaaaaatccctcctccccacaatcttctacacaaatatataggtgaaataaaaatacatgtagataaacacacacagagacacaacacatatgtagatacatataaagagaacatacctattgggataaacatactggtagccttctacattatctgctaacatgaacatgcatggatgtgtgcacacaggcctaaatatggaagagagaaagagaaagcaagggagagtgcaagaaagagagaggaagcctaaaattcatccctgaagtccacctattagtactttacccaattgcccagctatgcacatacttactttcacaaaataaagattccattata

SEQ ID NO: 400419 - DNA, 455 bp, Homo sapiens
gtaacttgatctatgaagcatccttcatagatatatacaataataaatcttatatacagagagtttttacatgaaagaggacgtacttagacttagtaaatgtaaattcatttcaaagtgttgctgatactgaattcatagtacttttgtcattatgaattttttcaagtagtatgtgctatgaaaataattatcacaagtggaggaagccttgtggtttttttaaaatataaaaagagctctttcatacttgaaaaggttggaaaacatttgtctaggccagtggtctccaaactcaagagacagctcccttatcactaaaagaaacttaagcaaacaatcaattactttttatacatgtattttaaatagattgtgtacaacagtattgatgtgttatgtaatattataaatagtaataaaaatagaaaaaggcttcagataaaaaaaaaata

SEQ ID NO: 400420 - DNA, 617 bp, Homo sapiens
ttacaatgaggtcgtgagggtaggtcctaatccaacgtgatgggtgtccttataggaaggggacatttggccacaggcggctgtgaagggagaacttcatgtgaacgtgtagacctgcacgccgaggaggggcctggaacagatccatccttcacagcctcggaaggaaccaacctgctggcacctcgatctcaaattcctgcctccagaactgggcgacaaggcgtttctgttgttgaagccacccaggctgtggcactttgttatggcagccctagtgaaagaattcagtcacttttatttccaagggaagccgagttaaatgagctccctcaagagatcttcctgcaatatttgggacgtgtctgtgtgtgcgtggacagggccgtctgcaggcggaccagcatgcggcgctggcaggcacctcctgtgtcacccttcaggcatccagggaaggaagcagatcttcccagctgttccgtgttcaggcctggctttcgagaggcttcaggccggaggggggaaggtggctgaagctggtcctcggtctcttcgagcccctcaaagaactctctgggtgcattagaaaccatccttgtgctgctggcagcagttgc

SEQ ID NO: 400421 - DNA, 484 bp, Homo sapiens
tgaaagccacaatctgccctggaaacccagctccaccctgcttccactacatcaggaggtgaaggaggaaattgaaagtgtgaaacaccagtgggaggaaaaggttcctgtaacaaatgtggttatcaatgggaaagaagctttctagagcttatatacggggccgagtcatgcacacttcatcatactcaccaggggacgacccagaccatcattcttctctggtctgccaccttcatcctccacttgcagcctcctttgcagtgaccatacaggtgcagagcatgagcaggatgcacaggggtttatgtggtcaggcctgcctggagttggcacatagcatttctgcttccattcttaggtctgaaatccaggtcacagagccctaacataactacaaaggatcctgaaaagtgttgtattccagtgtgcctcggaaaagaaaataggattaataaactttgattagactaaatcattgaga

SEQ ID NO: 400422 - DNA, 585 bp, Homo sapiens
tgaaaggaaaacatataaaatgtacaaggcactggagagaagttatacatgatcgctgccttcataatagattcattgatatacaatgtgaataagggttgacaaataccagttgaataaacaattattaaaaagtttcaagtggaagcctcccatatttctccactatatttttgcaagtgcttaacaaaacaaaacaaaacaaaacaagggtttagggtggggaggggaataaaacaataatcaaaagtctcccctaattatcacagtcaggcctgaattagtaaccttgaatatcaaacacaaactctcaaagtataggacagaaacaacaaaacaagtaattattaagcacctactacatgccaactacagttctaagaattgaaacaaaacaaaacaaaaagggcaaggagaaacgaaaagataagacaatgaaagagaagtcgaagtcaggcccggcacggtggctcacgcctgtaaatcccagcactttgggaggccgaggctggtggatcactagagcccaggagttcaagaccagcctggccaacatggtgaaaccccacctctgctaaaaaaaaa

SEQ ID NO: 400423 - DNA, 706 bp, Homo sapiens
  misc_feature (580)..(580): n is a, c, g, or t
tgaaaggaaaacatataaaatgtacaaggcactggagagaagttatacatgatcgctgccttcataatagattcattgatatacaatgtgaataagggttgacaaataccagttgaataaacaattattaaaaagtttcaagtggaagcctcccatatttctccactatatttttgcaagtgcttaacaaaacaaaacaaaacaaaacaagggtttagggtggggaggggaataaaacaataatcaaaagtctcccctaattatcacagtcaggcctgaattagtaaccttgaatatcaaacacaaactctcaaagtataggacagaaacaacaaaacaagtaattattaagcacctactacatgccaactacagttctaagaattgaaacaaaacaaaacaaaaagggcaaggagaaacgaaaagataagacaatgaaagagaagtcgaagtcaggcccggcacggtggctcttccttcatttttaaccaatgaaaaaagaaggaaaaaaaatatccaaatgtatatgtttccttggtagtgacctaagacagactcaggacttttgatttccagtccnctgttatttctttttcttttcatttttttgagacagagtcttgctctgtcactcagggtggagtgcagtggggcgatctcggctcactgccctctagtctgggtgacagaatgagattttgtctca

SEQ ID NO: 400424 - DNA, 600 bp, Homo sapiens
ataattgctgtggttttcattagggattgataattttacttgagatagggagcagctggagatgaggcacctctaaaccaccagagtgaaatgtgtagtcagggccgggtgtggtggctcatgcctgtaatcccagcactttaggaggctgaggcgggcggatcacttgtggtcaggagttcgagaccagcctggccaacatggagaaaccctgtctctactaaaactacaaaaattagctgggtgtggtggcaggcacctgtaatcccagctactcaggaggctgagaccagagaatcacttgagcccaggaggcggagactacagtgaactgagatcacaccactgtactccagcctgggcgacagagcgagactccatctcaaagaaaaaaaagtgtagtcaggaagtgttttggatatgaaacatagcagagaagtgtcttctgtattaaaaaaaaaagttggcaggatataagggggctggtatgtaccattcctgtcaaaaagaaacacatttatgcaaatgactcaagattaagatctgaagaaaataaagacataagggaaccagctgcagaacaaagagtaaaaactgagc

SEQ ID NO: 400425 - DNA, 525 bp, Homo sapiens
tgactactaacctgaagtgggcattcgtactcccaagtctattcgttttcttctaggcaattatttcacacctatcctctgctcataacaccatgaccttcttcccaaactcactctcagttaaaggctttcccttcctattgaggaaacagaagcagacagaagagaactttcaactgccccaagctctatatttacctgcactagttgcatctatgcccatacatacactctgccttttttttttgctactgtggataaactgtccatgttctgataaagccatctcctccccgtgtaccagatcacgtactctcttacctactaaaggcactgctccaacaactgttccctcttccttctgcagcatcagcttttccctctctgatcattcctactcaatatagacacacataatgctgcccatcttaaaagaaatacattatgtaaattcatcatctctaatctctgtcattccattttcttaaaaacctattcctagcaggcttttgcccccaccatctc

SEQ ID NO: 400426 - DNA, 581 bp, Homo sapiens
ggtagtaaataaatgtgtatagagaaacaataatatagactgtcatatttgagtacctttaaaaaaacaatcccaatgtgtaagtgaaaaaaaatactagtaactaagtattaagtagcaattaaattaaaactaaaaggaaaggatgcatgcagtgactagagaggggagaaagggtcttgttcaaaatttcagaaatagaatgaggctttgtgataaaaaaaaattcaagttagagattgttagaatcaggtactaaagttatcagtgaagacagaaattggttcactgggaaaatgagtactaacagcagtaatccgacataacagattttctcagacagataagcactaacttcagatgataaaattacacacagagaagaatcatacatagccgaaaacaggaaaaataaaaactgaggccatttttatttcctatgaaagtgtgtgtatacaggaagcacccagtgaatggactgcagaagcgacagtcgtgagtgtagttagggaagagttacatttcaattaatgtgaggaagagtaagaaataaaagtagaatagggctaagtattactcag

SEQ ID NO: 400427 - DNA, 496 bp, Homo sapiens
cggatcgtggttccaatcacagcctgagggccaggaggctgggacctggtttgggccagaacttcttcataaggattaagccctctctcccctttacctccagaggttggaaacatcttcccctgtagcaaggcagtcaccttaaagctgcctctacttcccgttactcctgctacttctccgacccttctcactaccctctagttgttttaactcagtcatggggatccttgacacatccagacagagagagagagaaggcctaaatttccacaagcagtagcgacttcccaggtacataaagtcccatccttcaaggaagaggatgtgtggttccaacctgaatacaggttcctaacttggtaagttgaaaacagcatgctgcactctggctacctccttaaaacaataaccatatcctttgtggaattattatagaagtaatttaacatggaaggaaaatcattgcattaaaaagataattcatttaaatatt

SEQ ID NO: 400428 - DNA, 444 bp, Homo sapiens
caggcctggcatatactaggtccccagcgaatgcttgacttaatttaattattcattaaacaaatgtatatgagtacctatcctgttttctacattgaactaagaaaataatagatccaatgtcagcataacctaagacaaagtaagaccttggaagtttcgtaaataaaaattttgtctgaccatgttgtggttcacaagcatgataactctgtttttacgctcacatgtgagacatgcctccttccaatcttgttatgtcagcacattatccatctgatgcgaaaaaatttttctgtttcctttagctttcagagagcattaatatccctattttatttacctcagactaagaaaataatctccacttaccaaatgcatgcatgtttgtgatataaaaagaaataaaatgaatattttactattatgcattaataaaagata

SEQ ID NO: 400429 - DNA, 404 bp, Homo sapiens
tctaatcaatagaatatagcagaggtaaaagggtgctgcttctgtgattacattgcacaagattttaacttccatcttgcgagaaaactctctattgacttcttccccagttgtctttgataacgtaagtcaccgtatcgcaaggccctttggcaaggaagtgagagcggcctcctcataatagtcagcaagaaactaaggccctcagctcaacagcctgcaaggaagcaagcccagcccacaaccctgtgagcttcaaagtggattcttcttcagtcaggcttccagatgacagcctagcccttgatcgcagtctgtgacagacactgaagcaaagcatccaactaaactgtgtctggattcttgtcccactggagttaaaataataaatttgcattatttaa

SEQ ID NO: 400430 - DNA, 236 bp, Homo sapiens
ggggggcggcgggcgcgaccgtcccggataggagcgcggcccgggtccgggctggacagggcccaggaggcgaagaaggcctcccacagccatcaaccccacccaccatggccggcgcagcaggccagggacaagccccgctccttccgaagctagagacagagaaactgaggagctgaacgcagcaatttcctcgccccgacccccacactcccgacagcggaacaagccagact

SEQ ID NO: 400431 - DNA, 398 bp, Homo sapiens
cactatcctcaatatcctcacataagaaacccaacaggtttatttcttatcttggtccaagcctaccacttgccttcctacttgtctattctcaaggaaaaaaaaaatcacacaatcatcattacaaacctcatgtggcactgagctttctgtatgaggctattctgctttgagactgatgacaatacctaagaggatcatgcatgctctattagtttacttctctgtcttatatctcaatttttcccttaacatatccttatgttttacctacaatccctttgttttcctctctattgctctggagtcaaaggatatgttattacagatataagacacccgtacacattcagtgcccactgaacactgatcaacctactataggttttctttaaaaa

SEQ ID NO: 400432 - DNA, 280 bp, Homo sapiens
tcactcttttaaaatgaatcataaaatccagcattttgctctgcttgtcccattacttatccataaaaactagatttaatttctactgtaattatttttttaaaatacacatttagtgctttaagaatggaataattacaggtcgggcacggtggttcacttccgtaatcccagcaatttgggggggtgtggcaggaggatcacttgaacccaagttcaagtggagtttgagaccaggctgggcaacaaagcaagatccagtctctacgtaaatagaaat

SEQ ID NO: 400433 - DNA, 873 bp, Homo sapiens
ctgcgcaggcccagcagctaagatcgggtccggcgctccagaacagaacgatccctgaggctcccttgctcgaactgtgggacttaccctactatggtccgagcctaccctatttcattatactcaagtaacgccccagaaattccagagaatctcacacaaagaggttgagtcttgccgtggtgccttcaggggaatgtcatcccgggctagaagagctgcaaaaggctgtcaggcttctcagaactttgcttctccagcagaataatcctgcggaagactgagcagttcttgtgagtgtaaaaccatggcccatgcattggtgacgttcagggatgtggctatagacttctctcagaaggaatgggagtgcctggacactacccagaggaaattgtacagagatgtgatgttggagaattataataacttggtctcactgggatattctggctcaaagccagatgtgattaccttactggagcaagggaaagagccctgcgtggtggcgagggatgtgacaggaagacagtgccccggtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattg

SEQ ID NO: 400434 - DNA, 650 bp, Homo sapiens
ctgcgcaggcccagcagctaagatcgggtccggcgctccagaacagaacgatccctgaggctcccttgctcgaactgtgggacttaccctactatggtccgagcctaccctatttcattatactcaagtaacgccccagaaattccagagaatctcacacaaagaggttgagtcttgccgtggtgccttcaggggaatgtcatcccgggctagaagagctgcaaaaggctgtcaggcttctcagaactttgcttctccagcagaataatcctgcggaagactgagcagttcttgtgagtgtaaaaccatggcccatgtttgttatccaggcataagaccaagaaattatcttcagaaaaggacattcatgaaatcagtttatccaaagagagtataatagaaaaaagtaaaactcttcgtctgaaaggatccatttttagaaatgagtggcagaacaaaagtgagtttgagggtcaacagggacttaaagaaagatctatcagtcaaaagaaaatcgtctctaaaaaaatgtcaactgatagaaaacgtccctcttttactctgaatcagagaattcacaatagtgagaaaagctgtgactcacacttggttcaacatgggaaaatagattctgatgtgaaacatgattg

SEQ ID NO: 400435 - DNA, 384 bp, Homo sapiens
caccatgcacagcctattcaatcatttagtatggactcctggactttgggttacaatgtaataatactttattttgttgctcaaattgctttggccactgggtgttcatgtgtccttttcacacatccccatcactgtgtgtctggttttgttttgttttgtttttgagcacttttttactttctgacactgcaagatgccccaagctcatcttcttttaaatgcctgtttcatgacaaacacatgtttaaaatttttaatacctattttcataactgatgtgtcttattagaattaattactgtttcataacttaggagctgggacaaatcagttcacttagggatagtagaaatagatgttaaataaaactttcccaaagca

SEQ ID NO: 400436 - DNA, 529 bp, Homo sapiens
ggtcattggaatcatgaaagaaatagtgtttatataacctctctcttgcagagaacttgaaagtgatttcctttcgttttatgcaaataatatatgggatttatattacccactttgtcaaactcatcttccttgtatgtgtttggaaagcttattcactggtggtcaggcttcttgtttttcttctgggtagactgccttttagacaataaattctgaagtctttgttaattccgagctgggaggatacaaatggcggtccatcctgagtgtgggaaggagaatcagtttgaaagagctcttttatctgcactccttagactttttagtgttgtttcggttattttagtgtattgccagactcacggagaacttcgtttgtccaaagctccacaaaggctgcaaagataaaccaagctgtccatgtccttactggcagggatcacagagtctagtgggtgagagagtgacagataccataatacaaggcaagtaagtactgggtgcatgcaaagtgctttgggattgt

SEQ ID NO: 400437 - DNA, 668 bp, Homo sapiens
ttctataaaaagagaaaagtttaagattagaactttaaataacataaataaatctttctttaaacaagcctctcttctcccaaattttacatttaaccattactattgtatttagtgtaatatgcactatatattatatgtaagcactcagccgtctaataagaagtctttcactgggaagagagtctcaatggatgaaatgccaacttttcactctcttctactgttctaaagacccattcagaaatatgaataactactgggattagggtgactttgctggttttagcattgaaagtctcctgtcccaggcaaaacaggacaattggttactctggtccagtgttctcctcacatgacttgataataagaataattctttctaaattctcccccatggagacggttaatcagtcaaaacatttcagcctttcctgtcataaaaataaaaaacactggcagcatgtcagggacgggcaatgtcttaccaagttattttctaagtactgattaggtactgtagtattgaagaccccattgaagatgccttaattgtaaagagtagcaatcaaaattttaaaaagtaaaaaagaagacattttaagaaaataaaaggtatcagaaatgcaataaagttatatcagaaagttgtagttcgtaatctattt

SEQ ID NO: 400438 - DNA, 271 bp, Homo sapiens
ccagctactagggagcctgaggcaggagaatcgcttgaacctgggaggcggagcttgtggtgagccgagattataccattgcactccagcctgggcaacaggagcgaaacttcgtctcaaaaaaaaataaaataaaatataaataaccatgccctataacataaaaggaaagtaattgatagtaaaacaaaatatgtttcaatatgtaagtttctgggcacaatagtgctggaagttgcagtgaagctgtcccttctgtgtggaccctcta

SEQ ID NO: 400439 - DNA, 629 bp, Homo sapiens
aatgataaatgctttacatatactttatgaaattatatatgctttagataaaagcagaggtttcataaaactgaactgtaacatgcatggcatttaaatcccattgaagtgaagggctgggcttgagggtagcgtcaccctccctgaccgtcatacccatatccatttccccaggaaggaccaggatgctttgtttaagcagcacgtttgaattgctggcattgcctgtggcctccctgtggcgagggatggtgaacgacagcgttttccctcctccttcctcaccttgcaaacctcacttcgttggatgcataattgctgactcatccccatggatcgccttggactgtgtagcaatcactgctcttttcacagtccctcttgaatttctttcctttttttttcttttagtcggaatttcgctctgtcacccaggctggagtgcagtggtgcaatcttggcccactgcaaccttcacctcctggattcaagcaattctcctgcctcagtctccccagctatttgggaggctgagcaggagaatcgcttgaatccgggaggcagaggttgtggtgagctgagatcgcgctattacactccaggatgggcaacaagagcaaagctccatt

SEQ ID NO: 400440 - DNA, 465 bp, Homo sapiens
gacatatcctcctggaaggagctatagccaatgacccacaaaggtagaaatctatcttgcctataaataatagaaaacccaacctccaacagtttcagcaaataggcttgtttgttttttatgtttcaagaaggtcagagattagggctgctggtatttggtttggctgcttaaagaggcccttagggaccagacttttcctgcatttctacacttccatcctgggcatgctgtgttttcatcatcacgtttatcacctcatggtcacaagatggctgtcacgattccagtcatcacatctgcattcaaggcaagaaggagggagcagatggcaccaccaccaccaccaccaacagtcgtagcagtaccactgataagaagaaaaataatagatacttattgagcacataataatagtaataacaataatgacaataacaaaaatagatatttattgatcactta

SEQ ID NO: 400441 - DNA, 306 bp, Homo sapiens
tcaggcaatcctcccacctcggcctcccaaagtgctgggattacaggcgagagccaccatgcctggccaagacagccctttttttctggacaatgcctggacacatgaagcccacagacatcccccctccagggtactgggtagacacacttgccgttgggcccaccttgcgaaagtgaggcagctggggcaacatttgacctcagtgagactcatttcttcactgggggctctccaggagcctgcggtgaattgggccctaaaacatcctgtgtgcgcctttcctggcaggttctgcgacagcaa

SEQ ID NO: 400442 - DNA, 891 bp, Homo sapiens
cccggtaccttaacctaagccagacggatgtacagcatgctgatgagctcatttagtcctgttgtccgcaacccagtggactgcagcgtgtaacagctctgtcagtcccttgcctcactctggctcatggctccggggctggttcggccttgctgctgcttcccatcacaaggggtcgcaacccttctgccagcggagggtagaggaccacagttgttacagcctttggtgtacccatgttcagtggatccctacttctggtcctgcatccaagaacaagatcatgctgacaattgaagggtgaggagggtggagaaatatcttattgagtgatgaaatagctctcactggagaggggatgcaagggtggtcctctacccgaagttgggtggtttctctccatgtggctagtccggagcttttatgggctcagaatggggagtgtgtgctgactggtttgtgagtatgcaaaaaatggctaaaacaaaggcaccacttagaggtgggcacaacagtgtaaaaaaccaattaggaaaggttaggtgtatgtaaaataggtgaagggtggggatcaatcagaaaagcatggcaaacaggaagacgggttttcaaaccagtccatggatttaccccgggacttgtagctaggctttaaactgtctttggctggaaggtcaggtttcatcagggacccatccctgtctacttaggattcatctgctttctggccaccattacaatgaactaacgaggtccaacccagtgctggcaaaagtaaagtgagaaaaacagcaagtttatctattctatagaaatccacaagtggacggggttttcagtgttgttaatgtcaattataaagtcataaaagaggctatttatgctaagggg

SEQ ID NO: 400443 - DNA, 804 bp, Homo sapiens
ggttcctattgtgtgcgtgctagtgacccaatcacacgcatggaagcgcacgcatggatgccagccataccacctcttcaggcagtctgtttccattaggtcacaagcatgaaggtgaaagaaaaaagacaattattccacgtgaacaggtgaaagaacaatcttcgaccaccagactcaacttgagttgtcttatgaatctgtactgctctcagttttcttgtacccagattcttcaagggcacatggaatggtggctgccgatggaagtggcgagacctcaacggtgcccaccccagctgcacttgcttcctggggatctgcatcgctgcagcctaaccttgaggggtggcagggcaagtgctgtttcccagctcactctcattcaacaattaagatacaactgctacgttttcatctaacaatactgggagaacaaaatacgactcaatggtgaaatgtattctgggttatctgatgaagttttatctttaaatattttgttatccatttttggcattgctatgaatttgggactgttgccaccaactctgagggattttaaactgcttttagagtttgtgagaaccaagcctcaggggatgcatgagtcagttgaagcactgtagtcttgttggtctctctttgacatttcatgtctctggcatatctgaatttaggttgggaactggaggtttggtacacttgtatctattactacccttcataatctggccagttccatactcatggaaaacaatttgtttgttcccagatggctgcagcatttcatttagagttggg

SEQ ID NO: 400444 - DNA, 1467 bp, Homo sapiens
  misc_feature (691)..(691): n is a, c, g, or t
  misc_feature (832)..(832): n is a, c, g, or t
  misc_feature (878)..(878): n is a, c, g, or t
  misc_feature (904)..(904): n is a, c, g, or t
  misc_feature (1017)..(1017): n is a, c, g, or t
  misc_feature (1024)..(1024): n is a, c, g, or t
gggacatgtggaactccactccaaaagcggcggcttgcggcggagctctctctagtcaggcggccagctggcgttcgtggcacacttgctgtcggctccgctcatctgttgggaatgcgtcctgtgggcctagtcctccgctggaagaaacgcgctgttctccccaaccaccgtttatcattcttattcaccgtctccggaatgtccgttcagtttccgctcctgagagacttagtgactgaggccaggcaaagatttcaccttggggagggggaacgttaaacctttcctccagcagctttcgtgttttaaattgtattcatccgccatggaaagacatcagaagcccaggatctaagagacagactgaaatgaagaaagtagataatattgtgagaataatgaacaagctggtcactgaacagcagaaccgtaatggagtcccagttaaagggttttaactttatttcgtcactttttgcaagcatgatacaaagaaaacaaacacctaactacgctacggtttatagttaaaaggaaggtggaagatcctgagtcattacagcaatcacaaaacatgatggatttcttcatttaaaaacacaaaagaggtcttggcatagttttcaagggcaaagcatgacaagactctccagtgctttctttcatccccctctgtgtgcctttttcngcctgactcacagcctggctcaatcctaatctttctacatgcaaagatgcagcatttaaagcaatttttcctgtgcagtatttgtagaatgacagatcctgccagaagctcttggaaacattttggaactatcttgctttnctgtatgttatgatccatctagcaccgttttcctcctgtggtagcnaatgacacttttttcaagcatcagcngcagaaatgagtctaccagatggaataagatactggtaaagggaaagatttgtttctaagactgcatcaaatgaatgcacccaaatctgtgagttgattaatctgtgaagaantacaacnggcagtatttacatatctcaatgagtctcaaagtgtggtcgaggaagcctgggggcccttgggaccctttcagaggttccacgagctcaaatctattttcataacctgctaagtctttatttccttttccactccagaggctatataatgtctgatgacatcatcgctttataggatgagagaatacgtgcttgtatattcttgtgtttgtaggactttccaggtttatttattaccatatggcaattttcaataagtataacccacaaaacccaacagatttttggggcacctctaacaagggtcctaagaccaaaatgtttgaggactgctaatcgatattattcaattgtctagtcccctaaactccaacccttcttatcaggactacagagagaaaacaggtggtcttcttgacaatcgctttgtatttacattcagtg

SEQ ID NO: 400445 - DNA, 300 bp, Homo sapiens
aaatcttaattagcttatgtcattggacgatttattagaagtaggccatttatgcctttctcaactctttttttttgagacggagtctcactctgttgcccaggctggagtgcagtggcactatctcagctcactgcaagctccgcctcccgggttcacactgttctcctgcctcagctactccggaggctgaggcagaagaatggtgtgaacccgggagacagagcttgcagtgagctgagattgcaccactgcactcaagcctgggcagcagagcgagacttcatctcaaaaaaagga

SEQ ID NO: 400446 - DNA, 644 bp, Homo sapiens
taagggcctgattcttcactgtcttcttcatgtataccaactgtgctctgcaaaactgaagaaacaaaattaaaaggaattataacattactttacttgccattcagctctgataaggatgctctttgaaaccttccttggaacttgagagggagctgggggaaaaggagtgtgaaatggaaagcagaacccgggaacttggagaaaggctacagaacaactttgcaccaaacacctctaagctgccatccttctccccaggcccagtgttgccgacccctgtggatgtgggcctgttgggtggattcacggtcattgtaagggctgctaccgactcttaagatcagaggagacataccaaaagcccaccatactagatgtttgcaaaactaaggtgagagattgaggtgatacatagatgatgcacttaaactctcgtaccagtcttttgtgtgttccaactctatatcttatcagctctatcagagattatcatctcatcatttagagcaataatcaaacagaaagcactaagcttccatggaagccacctggcagaagagtgtgtatttagacataccctggaagggcttcgtttgtaagtaaataagtgatttctactcttaagagtggtctttgaacaa

SEQ ID NO: 400447 - DNA, 456 bp, Homo sapiens
ttttttcaatttaaaaatagtatagaaatatttcacatttactactgttggggaatgagttataatatttcatgaataaagttcaccttctgagtgttgaaactttattttttgtagtatgggatggaaatatctaaaatgtgcatcagtcctgacctcttgaaatgggctatagtaccgacatggactggtatagtttcttatttttaacccctcaagagtgtcaacttaaaataatcaaaaggatcagaatctagtttaaagagagtttattcaagtacagagtttaaggatggcctcttgggaagcacagattccaaagaatggaagtccgtgtttcaaagtgtagaagtttgggatttcttactgtattagtccattctcacgctgttataaagaactgcctgagtcccactggccctccagtgagctgagggtttttgcaggaaaaaaaaa

SEQ ID NO: 400448 - DNA, 400 bp, Homo sapiens
cagacaggtggcccaagcacaatggattcaatccataatggactcccaatccagtctaaccggtctgggcatctctgcccctaggggactgagcccttaataaacagatgtgtcttccagctcagaactgcagacatgtgcgtgctcatgtttatgtcagtagcctttgttctaaatccataccaatacccgtttagtatttctaacagattggttctttctgatgtgactgtctgaacaaatgaaaagcatttccctgtggcctacctgtcacacttttttccgtcctctaattgagaacactttcaaacctctccaactcctgtttgcctcgcagtaaggtgaagatttgatttcttccctattacaattttcttttgagtcaaaacgagtatcttgg

SEQ ID NO: 400449 - DNA, 427 bp, Homo sapiens
ggttggagatgcatatgtgcagtatgtaattacaaaacactgttatgttggccaatacaagtgtgtacaaagcatggaaaaaggatggattccttgaagacagaacctataatctgggtttttaaggatgagtacagaacaataactaaataactttgaggggatattttaatttttttgtctgttggtgtggttgtcttctactacaaatagaaatgacagctgagaagcaggtagaatgcagttacaaatacgttgtttttgcacctctgtttgtgatcatcaaaattgtgtgtcacatctgttatgtatgttaaaaatattctttcccaatgtttcacttgattttatcatgcaaaaatagttttatgtaattaagtatcttagatcttattaaaggttttgtatttttcccagaaagttttcc

SEQ ID NO: 400450 - DNA, 170 bp, Homo sapiens
tttctagagatagaaaattaaagtagtaatatgtactacttatctctgttttgaggcacctaatctataaaatggagttactaatactatctaacttaaagagttgtgagtttgaatgacataataaatgtgaatcctccagtattatatcatgcacaaggtaaaatttt

SEQ ID NO: 400451 - DNA, 945 bp, Homo sapiens
catctaatggtatctggctagggaaactaggaatcagcaaatgcaagatatactgtttcttcttccccaaagaagctttcagagaagatgacctgcccatgatcaagtatcagtgttcttgagaatgtatcatgaaatagcattatatagaatatgaaaagtattattcattcatcatccactaagagttgttgtgtatcccttaactatagggtcctaatgtcactttatctgtccttactgtcatttttcatcaactctaatcttccactaatagtagatacatactattttaatctgtcatctaacatacaattcgaatatttagttaaattttcatagtacctttactcctgataaaaagagttatagcacaaataattgaacattaactttgtttgccttttgttcatcaatcgtccctggagggcaagtggtgtggaatttttttttttcctccaggactaatgagaaggtatgtagtgggttatctgcagctcttgccagttccccattatagccagtggctcatatttttaaaagctctctgaggttgaaagtgccatcaggcagcttggatcagggtttatattttcaggcaaaagacaatcaaatttaaaaggcaaaccttaaaaaacatttgggtaaagaaatcaggttgaaaagaaggaggaagaagggataaaggtgataaggagcagatataaaagaaggacataaatacttaatagtaagaattgtaagagtctacagcttggtcaacatggtgaaaccccatctctactatattcaaaaattagccagcatggcagcgcgtgcctgtaatatcagctattgaggaggctgaggcaggagaatcacttgaacccgggaggcagaggttgcagtgagctgagatcgcaccactgcactccagcctgggtgacagagcgagaccccatctca

SEQ ID NO: 400452 - DNA, 276 bp, Homo sapiens
atttgtagtttattctattaaggatgagaataatattctttgttattctgcacatttttaaagtgagtccagaagtctagtcaattgattgttgataaagggtcaagattcttcaatgaaaaaggatattattttcaataagttgtgctggatcaactggatgttaatttttttaatgatcattaactcacacaatacataaaatatcaactcaaagtggattatagatctaaatgtattattaactcataaaattcttagaataaaatctttaaa

SEQ ID NO: 400453 - DNA, 707 bp, Homo sapiens
agatagtcactctgcaactacaagatggcactggattagtgattctcagacgtttttctgcaccaaaatcacctaaaaggctggtttaaccgactgctaggctccacctccaaggtgtctgagtcggtaggcctgaggaaggcctgagaatgtacatttttaacaagtcctcaggtaatgcaggtaggcagtatgactggattgtttttgtggttgcctgcctctttttggcattggaaaggggaaagccagagtattccttgaggaatgacatttggagagaaccaaattttagatgcttctgtgatatgtacaccagagctattctggactagattgtaaattctcacatttcacctatgcaaaaggaaatactttctggtctcctattagtaatcagttgtctcaaattttgcccgttacctctggaaattctggaccctcaagtgatcagtcttttaaggcagtgtggaagaacagcacctattatggcagttgatttttcatggtctctaccctgtccttcctaatataactgctattctttaccttcctgtttttcaaaactctcgtattgttcctgttgtgttttttctaaatattttcttggttacaataaagtgctaatatttaaagagcttttgggagcctgctggtgccagaaactattcaagttacttacagaatactctcattcagttctctca

SEQ ID NO: 400454 - DNA, 380 bp, Homo sapiens
gaaaagcattataattttggtcttaatactaacttcaacatgaatacttgcctatagcaccagggtaccaacaaattgaaattagataagaacttaaacatgaaaagcaggagaatcatcacaagttggtggattttgaaaaaagagaagattttttttcagagtcagttggattttaactcatctagtagttttaaagactgaatggatgaaagatgatagcttaaagaataaggtaacagtaatgactacctgaagagcacttgtgctcatcatcactaccttaaacttaagaagagatatttattgttaattgagaacctaactttacactaaggaagtttcattataataaagggtaataattgatttaagaagtt

SEQ ID NO: 400455 - DNA, 365 bp, Homo sapiens
tggatgtatacacgcaggtcacaggggatatgatggcttagcttgggctcagaggcctgacagacactaaatccaaggacaaatgtgctgacagatgtcaacctgaaatagtcaaaagggtcagaatctaatttaaagtgagtttactccagcataaattggtgtgaggctgccaccccaccaccccgagaaacaccagctccaaaggaatggagtcagcctgcccaagtagggaagtgaaggtttcacttacagcagcagagagggaggagtttttttagcaggatgaaaactcattcatacaagagtacagctgcccctccgtacccatgggggattggttccaggacccatatgcaaaccaa

SEQ ID NO: 400456 - DNA, 443 bp, Homo sapiens
gcttgtgcctgataattcatttctgaagtgcttcaagattgacgcatcagatttgcacaatgtgccactttaggagattatttcttccttccttcagccagacagaagactgcagtagggatatggttcctgtttgcctatttccatccacaactctgccagagacgaaagcagtgtttgaaacaattcaccaagatttccatctggaatcatcaagaatggaattgatcaaattccttaagaaatttacttaaagtcatgattttgacagcctagtgctacctggaaaagggacagcagcagcctggagcagttttctagctaacaagaattttgttagctatgtggccacctagtggctcttccatggatgtcgctgatgcattgtcaggtacacagacaattgcccactaataaagaagttattatctttcttggaaaaa

SEQ ID NO: 400457 - DNA, 564 bp, Homo sapiens
gcttgtgcctgataattcatttctgaaggtgcaatattaagtgtcacagtgtccagctggtgatattttcagcatagaaacctgttagacacggcagcattaaggagatggaatgaattgatttatttctcttctgaattgcttggcagtgcttcaagattgacgcatcagatttgcacaatgtgccactttaggagattatttcttccttccttcagccagacagaagactgcagtagggatatggttcctgtttgcctatttccatccacaactctgccagagacgaaagcagtgtttgaaacaattcaccaagatttccatctggaatcatcaagaatggaattgatcaaattccttaagaaatttacttaaagtcatgattttgacagcctagtgctacctggaaaagggacagcagcagcctggagcagttttctagctaacaagaattttgttagctatgtggccacctagtggctcttccatggatgtcgctgatgcattgtcaggtacacagacaattgcccactaataaagaagttattatctttcttggaaaaa

SEQ ID NO: 400458 - DNA, 731 bp, Homo sapiens
gcttgtgcctgataattcatttctgaaggtgcaatattaagtgtcacagtgtccagctggtgatattttcagcatagaaacctgttagacacggcagcattaaggagatggaatgaattgatttatttctcttctgaattgcttggcagtgcttcaagattgacgcatcagatttgcacaatgtgccactttaggagattatttcttccttccttcagccagacagaagactgcagtaggtaatgatagcttaaacttgggaaatgtccttcttcagagacagcgtcacggacattttggagaggatcagattactctacagctgctttccctggtggacctgaggaggcacacccctgagccaggactttaagggagagggtagaacaacctagaagctcagaagggatatggttcctgtttgcctatttccatccacaactctgccagagacgaaagcagtgtttgaaacaattcaccaagatttccatctggaatcatcaagaatggaattgatcaaattccttaagaaatttacttaaagtcatgattttgacagcctagtgctacctggaaaagggacagcagcagcctggagcagttttctagctaacaagaattttgttagctatgtggccacctagtggctcttccatggatgtcgctgatgcattgtcaggtacacagacaattgcccactaataaagaagttattatctttcttggaaaaa

SEQ ID NO: 400459 - DNA, 504 bp, Homo sapiens
cttttcttgaacattctggaatgctaccagccttgggtgagtacctctgatctagtctaaaccatgagtttagtttccttttcactatttcatgcatagtttgaactaggatcacttaccaagttaatataacttgcatagcaccctcctgcccatcagagaaggcagtctttatataaagataaacatcttgataggaatggtagttatggtcactttaacaaaaccttgaaatatatcatagaaacacatttatttagtagatacattatttgtgagtattaactgaaagaaagaggcttctaaactggcaagtaaagagttaggctaaaggatgaaaaagaatgccttggtatatatggcataatcagtagacagaaagcatctagatcactgaacctgggataatggtgggcatgaggtttgaaggagacattgttaaatcagtaaaagaaaaatatctgccaagtagcttggaataaacaaataggtttcatgaatcac

SEQ ID NO: 400460 - DNA, 1245 bp, Homo sapiens
attagtattagtaaatcattaaaattaatatagtattattttctgttactttattgtcctgcctcagtgcctcataagaactttgagcccagaattattatctcaggattctttggcaaactactgtaatcagcagattaatgtagtttctaatggtctccatctcctgggattccaacccttgtctaataccctccccatgggtgtcagctggatccataggcttgctgctgttgcacagaatacagcaaacatgatgagaggttgattctgtgattagttgacaaaagatgtgacttctgtcttggactcttttcaatggcttttttttttggcttcgcacattttgatgaagaaaccttcccatactgaagaggctcacattatatggaattctggacaacagctgtcaaagtactgaatataccatcaagcatgtgagtgagattgattataacttgtgagagtctctgaatagaagacccagttaagccatgcccagattcctgcaccacagaaacttcgagataataaaggttttttttttttttttgtggtgaagaatatgtttctcatctttttttataatataaatacttttgaaatgtaacttttttatcttaataaacatttaacaattcatttgaagatggataatcacagatacaatttttccaacataaccaggacttttctgtaactttgactaatagatgatcgtttgaacattaccactttgtaactgcatttcagactatgatttagttgaatcacccaaagtgtgtaatgtcttttaatgtgcactatcaattctgttctgccataatgacctcattttggcttcttaactatattcatctgagtcttgtggggtgactctctgaagaagaatgactgttaataccaagaacttctgttgtttcgataaataacagccagattacagccagaacctcaaggttgagcacagctgctgatgtttggaatcccagccctttgggattaataggcctagacaggaggatcacttgaggacaggagtttgagaccagattgggctttaatgcaagattttgtctctgaaaaaaataaaataaaataagctgggcatggtgtcacatgcctttaatcttagctactcagaggctgagcctggaggattgcttgagcccagtagttgaaggttacagtaagctacgataacaccaccacatcccagtctgggtgacagaatgagaccctgcc

SEQ ID NO: 400461 - DNA, 1301 bp, Homo sapiens
attagtattagtaaatcattaaaattaatatagtattattttctgttactttattgtcctgcctcagtgcctcataagaactttgagcccagaattattatctcaggattctttggcaaactactgtaatcagcagattaatgtagtttctaatggtctccatctcctgggattccaacccttgtctaataccctccccatgggtgtcagctggatccataggcttgctgctgttgcacagaatacagcaaacatgatgagaggttgattctgtgattagttgacaaaagatgtgacttctgtcttggactcttttcaatggcttttttttttggcttcgcacattttgatgaagaaaccttcccatactgaagaggctcacattatatggaattctggacaacagctgtcaaagtactgaatataccatcaagcatgtgagtgagattgattataacttgtgagagtctctgaatagaagacccagttaagccatgcccagattcctgcaccacagaaacttcgagataataaaggttttttttttttttttgtggtgaagaatatgtttctcatctttttttaaaatttcattattatactttattttgggataatttgttatggaggaatttgacaaataatataaatacttttgaaatgtaacttttttatcttaataaacatttaacaattcatttgaagatggataatcacagatacaatttttccaacataaccaggacttttctgtaactttgactaatagatgatcgtttgaacattaccactttgtaactgcatttcagactatgatttagttgaatcacccaaagtgtgtaatgtcttttaatgtgcactatcaattctgttctgccataatgacctcattttggcttcttaactatattcatctgagtcttgtggggtgactctctgaagaagaatgactgttaataccaagaacttctgttgtttcgataaataacagccagattacagccagaacctcaaggttgagcacagctgctgatgtttggaatcccagccctttgggattaataggcctagacaggaggatcacttgaggacaggagtttgagaccagattgggctttaatgcaagattttgtctctgaaaaaaataaaataaaataagctgggcatggtgtcacatgcctttaatcttagctactcagaggctgagcctggaggattgcttgagcccagtagttgaaggttacagtaagctacgataacaccaccacatcccagtctgggtgacagaatgagaccctgcc

SEQ ID NO: 400462 - DNA, 1247 bp, Homo sapiens
attagtattagtaaatcattaaaattaatatagtattattttctgttactttattgtcctgcctcagtgcctcataagaactttgagcccagaattattatctcaggattctttggcaaactactgtaatcagcagattaatgtagtttctaatggtctccatctcctgggattccaacccttgtctaataccctccccatgggtgtcagctggatccataggcttgctgctgttgcacagaatacagcaaacatgatgagaggttgattctgtgattagttgacgcacattttgatgaagaaaccttcccatactgaagaggctcacattatatggaattctggacaacagctgtcaaagtactgaatataccatcaagcatgtgagtgagattgattataacttgtgagagtctctgaatagaagacccagttaagccatgcccagattcctgcaccacagaaacttcgagataataaaggttttttttttttttttgtggtgaagaatatgtttctcatctttttttaaaatttcattattatactttattttgggataatttgttatggaggaatttgacaaataatataaatacttttgaaatgtaacttttttatcttaataaacatttaacaattcatttgaagatggataatcacagatacaatttttccaacataaccaggacttttctgtaactttgactaatagatgatcgtttgaacattaccactttgtaactgcatttcagactatgatttagttgaatcacccaaagtgtgtaatgtcttttaatgtgcactatcaattctgttctgccataatgacctcattttggcttcttaactatattcatctgagtcttgtggggtgactctctgaagaagaatgactgttaataccaagaacttctgttgtttcgataaataacagccagattacagccagaacctcaaggttgagcacagctgctgatgtttggaatcccagccctttgggattaataggcctagacaggaggatcacttgaggacaggagtttgagaccagattgggctttaatgcaagattttgtctctgaaaaaaataaaataaaataagctgggcatggtgtcacatgcctttaatcttagctactcagaggctgagcctggaggattgcttgagcccagtagttgaaggttacagtaagctacgataacaccaccacatcccagtctgggtgacagaatgagaccctgcc

SEQ ID NO: 400463 - DNA, 434 bp, Homo sapiens
acaggaggaagacagctgatgagaaccacatgtgtgccttggagctgcccgacacctgttagtcttgtatttgttgtgcttctgggaaatattttcatttgcaaaaacggctgcttctgcacgtggctatggttgcgtgcttctgcacatgtgaaaagttttacatcacacttggaggagaaaagaaacacgggcaaaacacttgtcatttactgctcccaacctcgcccctcccagaatgcggtgcattgtgtacatggtgtacatggtccaagttggaaactggcccattcggagataattctctcatttctgataagcaaaataagcaaagccttcctcaggcatattctggtcttgcctctctcttaatttctaactcggatgtacagtatctttttttttttttaataaagtattacataggaggcaat

SEQ ID NO: 400464 - DNA, 524 bp, Homo sapiens
agtagaactatgatttgaagtcagagagattggctctagagtccatgctcttaccttagaagcgatatctcaggagaagataccaaagagcaatatatgaaaagaggttcaggttgggggctatccagaaaaaaagcaaagcaggtgatatctaatttaggatttgaaggataaatttgacatttggggttaaagctgtaagaagagtgtcagaagagtatatctgaaagaataatgtgaaatggcttggaagcttaaagcatcatgtactttcaaggtaatataatcaatttcagatcgtaaaaggtctaaattggaattagagacgtgggaaaaaaaattagacgtataagacttttataccatttgaaggaatactttatagacaaaataataattgaattaaaagtatagtattgaacattataaattaactattttgtatttaaagagcttacgaggtcagtcaagggaaggcgaaataaaatagcttccaaactgtcttaatctggcattatgataaa

SEQ ID NO: 400465 - DNA, 266 bp, Homo sapiens
tcttttaaaaaaaacttccttgatgatgctcatactgtcaaagacatgaaagccaggagaaatccacaggaggtgttagggatgaagcatcatttcttagggttcaccactctgtgaagtaaatcacatctctctcacataatcataaacaatttcaattgtgcacatttgaattatgaaatggtatctatacgctgcttgttctttcataattcctaggccaacaggacctgataatgctacttattatccaagatatattctat

SEQ ID NO: 400466 - DNA, 495 bp, Homo sapiens
atgtgagaaagcccaggagaagcggatggcggatggcgtttctcaagctcgctgacgtcactcaagttcatgatccaaggcttcaccctactggggttggggggttgggttctactggaagagtgaagctggtggattaagaaaagtggtggtagggagagggagggaaaggagttctttctgctagtcaaaggagaaaccaaataaaatgaatgaagtccaagaaaaatacaactctattgtttgggggcataagaggctggctgggaggcttcattgagtaattcgagtcacaccctttctctgtgggcctgaaggaatgttggctgtttctctgcagcccaggtgggaggtgggtagacaggtctatggagatgagaatttcttggagctgttaactctctgaacatccccacggccttgcaagctgggaggctgggacacaaagaagcaggaatgcagtgctgaatcaaggccaaggagcagcggccatgg

SEQ ID NO: 400467 - DNA, 375 bp, Homo sapiens
cttgtggttggctagtgaccactggatgggacaatgcagatacggagttgaactttcagtgagttaaaaatttatttattttgttccttcaagttcaagtagcttttcagttctttcccttacgctttaaaataaatttgtttttaatatctatctacaatgtcgttatttccaccatttgttcacagactgggttttgtaggtgaatcttaacatggacttggcatgaacagttctgttctaaacagaagagggagcacagctcagggaaggccagtgcatgtctgtgggcaggttcctccctgtctctgattcctggggagtaagagcaggtttccagttaagacttgggggttttgtagtagcttgagctgt

SEQ ID NO: 400468 - DNA, 377 bp, Homo sapiens
caaatgccgagtgatccagggcaagcttgcagcccatgcttccattgtttctccacattcctgtgtaggtgttgtccagcctttatgaagtcccctagcaggagggttcacgccacctctcagctctgaagctcttcagctcctaagcaggaagaataggaaaggaatatcattatgttcattagcattttccttagagcttttcttaccttcttctccacgttttctcattggttgcactgaggtgcccacactgtggttcagtaaacacatgatgaacacaccgccttttcccactccgtggcgccttcctttctgcctgcgtgtctttcactctggcccctgttgtcccccatggctggcctgtgaggactgag

SEQ ID NO: 400469 - DNA, 456 bp, Homo sapiens
ataccagcaaaacagctaaaatcaaccatttcagaagtctagaagttaactagataaccagattgaactgaaacactcctatcgaagacacactgtcaaatctcaatgagatagcagggtctgtggcatttcaacttgtggctgttcccagtaccttctgtttacagctctttatcacagtagccatgaaaatcagcagttttgtggccaaatgacaggattaatctcttttggagctccattaaaagctccatccccagagcacagtaaatattttgtccaattagcaacaacctggaaaatttctgttcccaaggtgttgtggctatttgatttgacttagcaatcacctctgtgaaaaaggctttatttttaaggcattgccaaaagcaatagcaaactgctgacaagatcacagcatccacagtaactaaaatccacatgaggaaataaagg

SEQ ID NO: 400470 - DNA, 222 bp, Homo sapiens
tttttttattttctttattttctggcaactagcaaatgtcacatggaatatgattggcttacatttcattagagtacatagtaggttcttctaagtaatgctattcttgataagaaaaacactttgaatacttcaaactaaaaacttacaaaaatgtaattcttagttattgctttaatggaagaaagaaacatatttttaaataaaataaaatttaaatta

SEQ ID NO: 400471 - DNA, 199 bp, Homo sapiens
cttcatcaacttcattcctgagtcatacttacttaataaacaagacaagatcaacaacaagaaaggtggaagaacacagctggtttacctgcacaggagctaaatactttgcaattccattggctgagcgcaacaccaagaggctgactaagaggagcacacatgcacaactgctgcgtgggaaacaggatggcagcga

SEQ ID NO: 400472 - DNA, 646 bp, Homo sapiens
ggttgatccattttctaagaaagattggtatcacgtgaaagcacctgctatggtcagtataaggagtattggaaagacactaggattcaaggaacaagaattgcacctgatgaccttaagggtcatgtgtttgaagtgggtcttgctgatctgcagaataatgaagttgcatttagaataaactagctgattactgaagatgttcagggcaaaaactgcctgactaacttccatggcatggatcttacccatgacaaaatgtgttccatggtcaaaaaatggtagaccatgactgaagctcatgtcaatgtcaagactaccgatggttatttgcttggtcagttctgtattgattttatagaaaatgcaacaatcagatacagaagacctcttatgctcagcaccaacaggtctgtcaaattcagaaggagatgatggaaatcataaacacagaagtgcagacaaacgacttcaaaaaagtgttcaataaattgattccagacaacattggaaaagacatagaaaatgcttgccaatctatttatcctcttcatgatgtattcattagaaaagtaaaaatgctgaagaaacccaagtttgaattgggaaaactaatagagtttcatgatgaagttagttgttctgg

SEQ ID NO: 400473 - DNA, 423 bp, Homo sapiens
cccgggaggcgggaggcggaggttgcagtgagccaagatcgtgccactattccagcctgggcgacagagcaagactccatctcaaaaaaaaaagaacataaataacatcttactcaaagttcatctctaggctccgtctgcgcatatttccccactttcaagtgggaaccaaagcaaggccataaggctgcttgagacattgctgactagatccaatgttgcctaaaatgtctgtggtacatcagaaagctgtgtggagacactgggtagctagtagaagagccacggcacaggtccccagagttttggagcaaaagcaagccctcttccacatcctagcatctgacttaatcttgggtcctcagcatgcgagggttcatgaaacatgagctgccctttatgaactgggtgttgtctgcacca

SEQ ID NO: 400474 - DNA, 663 bp, Homo sapiens
aggtcccccgtgatgcagccgtgctggccttgcttactgcacaccagccagtctttcatattcatttctcaaatatgccacactttcctccggcctttgtgtgtgcccttccctatgcctgaaatgcttttcctgactgcttgtcttctagccttctcgttcttatccctcagatcttagcctaaatgtcaagtcctcaaagaggcccttctggactgtcctgaatgtaaactaggccgcttgttattcctgcttggcaaagcttcatagcagttatcataatatttaattacacgttatgtttgtctttacatgtttaatgcccgtcttcctcactgggctggctgtgagtcccaggaggtcaagcccagacctgttatttatttatttatttttgctttgcattgcatccccagtacatactaggtgtgcaaaacaaaacaaaaaacctttattaaatgaatgtggttgaaatagaattgttactcatttaaaattttggttagtttgtcattggactagagcagggaacaaagtctggccggaagtttttaaaaccctggcggtgaaatttcaaagtgaaaatgttactcgtaagttaaatgaattcatactgcagcctgggtgacagagttatactgtgtctaaaaaaaaaaataacac

SEQ ID NO: 400475 - DNA, 369 bp, Homo sapiens
ccaggggacaccagaacatctataaactgtcattcgccatagtaacaaaggataaagaaaatataagattcatcttggccaggcacagtggctcacgcctgtaatcccagcactttgggaggccaaggtgggcagatcacttgaggtcaggagcttgagaccagcctggccaatatagcgaaaccacatctctactaaaaacaaaacaaaacaaaaaattagctgggtgtggtggcaggcgcctgtagtcccagctacttgggaggctgaagcaaggaatcgcttgaacccaggggagcagaggttgcagtgagcagagacagtgccactgcactccaggctgggtgacagagcgagactgtctcacac

SEQ ID NO: 400476 - DNA, 675 bp, Homo sapiens
gtcatgtttgtatagcactcattataaagagggccttgctcccaaggtaatggtataatgagaaaaagtacaagtaaatgaggctgacagcaattggcacagattaatacctggcacagccaattccaccttgggaaaaattctgaagagaaatttcagagaaatttggtagtgataaagtataaattcatgatgggacgattttacattggaaataagagagattctgtcaagtttgcttgctggaacaatttccagtaatggaaaaagttatatcttctctttaactgtgtataaataccacaaaccaaagtttcatgtgatcaaattatttccgtttattatcagatggccagttctgcacaaagaatgtctcaggacagaaatgatagaattcattcttgtgagttggtgttggtgattagcaactctgacagtttactaccttcactgtttttttctaagccttacagttacaccccaaaaaaaagaaaaaaaagaaaaaacaacaaagaaacaacaacaaaaatcaagaagaaatacaaaggggttcagatacatagacagggatgtcaatactaaattttacaaaggacttgcacagtcaaaacctccttgatccttacaaatttctgagaaagaaatgttagtatgcatgtttgatacatgaggaaa

SEQ ID NO: 400477 - DNA, 264 bp, Homo sapiens
caaaacattcaaagggtgctcccagccttggcaatctgcacttctcttccatctggctgactccagctcctcccacatcagggctccttttgtttgagaaaagctggaatttggggaaattcaatgacaagctggctgttgaggaagattctgtaatatgatcatgcagctgttcggtgattctacatgagtgtaggatcgcttcagggtggaatgtcaaggcttaccagacattatcttggaccaattctcctttttccatga

SEQ ID NO: 400478 - DNA, 372 bp, Homo sapiens
ggctctatgagataatggaagttgggcaaggtgttattacactatctcttttgtttcttttgaacagaaccccattcacagacaggaggcttgtgggaggatgaaaatttaagaacctcaggcagagtatcccctttactcccatttggaggttctgggatgatgatggtgatgatggttattattaactgagcaattattctctggcaggctctaggttaaacacatttcctaccttaatgtacttaattctcctaacaacccatgagatgaaccctactgtaaagtagccacccctattgactctccattatcttactatgttaattttcttcatagcacttattactaactaaaaataactaatttacc

SEQ ID NO: 400479 - DNA, 2816 bp, Homo sapiens
  misc_feature (1961)..(1961): n is a, c, g, or t
tttaagtcaactgaattttattccattgacaggttagcatgactatctttgaagatgaaaaaaattgttgcttgttgggagaaaaattgggagtggataaggtattaagacttctaatctaatgaggaaggcatcaatccttactcatatgattcctggccacaattcctctttatatcaactaccttagaatgtgcatagcagcatctataaatataaatcagaatggagttgtttcaagaacagtgtacatatttttaaaagcatcacttaaagcattctttcatgacaaagcttaagtcacttttgttttatcataaataaagggaatgcaggacaaattcttggcacaaagttatctgtcgaaaagtaaatgctgtttgttatcatgagtgatttattgccaatattatgattttcagatgcactgagttagttggtctcatctttttatgggctacattgacttctattccttctcctcaacttgtgccatggaaactatgcagtgaaataaatctcaaggggataatagtgtgatgaattggttttgcaaaatgcgttttttttatttccacatatatatcactccttcctgataggaaagaaaataattggcaagattagtgttctaagtctgtaagcaattttttctttgaaagttcagtaactcatgaaatttattaaaagtattaatttagcacctatgatgtgccaggaactgagggtactaaggatctggcaacaacaacaacaaaaaaaacaggttaagcctctgtcttcactgcgttgactttcaagtggagagtctgacaggtcaacaaacaaatattataaatatatccataagaagccagcagcaagtactataaaaaatcaaggaatacaaaagcaaaaataataaatgaacgggttaaatgttattttctgtagtctggtcagagaggccagatttctgaaatagagctagtttaaggaaaaaaaagcactagtataagaaaaaaactaaagctattaatatcttgagaaattgaaattcacaaaacaataagggaaggaatgccatcagaatgctttctgaggtagtgcgctcttgttccaataggaattttaattttaatttttatggtaagaaaactgccattttgaaaaggcctttctgagcattcaatgccttcacactgacctgtctagtaaacaaaggttatgccttactatatgattttttaatgtaaggcgtgcatgatatttaaccctcagtttcttaaagtgagcatcagtttttaaaatgtgatggacagcctaatttgaggataattttagaaagactctcaaatgtaattcatacatttttctggaagtttcttctaatagttaacatttttcatgttgtaattatataatgtacaaataatgcatataatgtataatgtcatgttgtaattatataatatacaaatatttaaacaaatgtctaaaatgtaggttatgtggattatttacactatgcatgttttctcctctgattgagaaactaccatcaatgttaaatttagaatttatcctaacagacgaaatcaaatagaatttgtcataatttaaattgtaatttgttcatcatatatacatattagtctacacccatgaatatattgttataaattacatgcacatttgttttttgttttaatgaagaatcatcctggactggtactttgttttagctagagcttgttagcatagataccatcaacatctagtgaaatcatctttaagggatctggatttatgatatctgtggagtgagagtcatactggccaacatccagtcatgtcattaaaatttagaggcggatcttctgaaatgagagaataaaatcttctttgtgtataaattgttttattagataatgtgttgatactgtaatatttcaactcaggtagaaggcattttaattaanatgtggattaaaatacctataaatcttaatgaaggtgaaatctattccttatctagacacatctgagccaggcaacagatggagcaggtccttgaaccagaccttgaatcaggaccactgcttaacctgacacttgcttagaggcataggcttattaaactctctgcttcaggactccagtaatgcaatctcggtgaagaaaaataaaatttagtatacctgaaattaacactttataccagcaaatttgaaatagcaatatgttagagacatctagccctaagaaaaacttgatgatcttggcaccaaacaaatcctttgatgtctcattaatatgtcctgtaccataactctggatatggatttttctctgtcttctagtaactatgaagcatgagataatttatccaaattcctgggcttgggatgaagatgcttttgcattgttcacaggtagccaattttattagttcattctgtcacttgtatcaactggacctgttttctgaccaataggctaggacataaggggattagattaatcactaaagtcttttataactcaaaatatgaatcggactattttgactagtgaatattttatcaagtcaaaagattagattttattttttccaagtcctaccttaacgttcattgttctttaaagaagaattacattttaaaaatcattgtctataacaatataaatgagttactaaaatccgtcaaacacatgacggataatttttgatgctggtggaagggatatgataaaaagtcaaaggcttggagtcctcagcagagaaataactggtctcagaaatagctttaattaaatgaagattaataaaatgc

SEQ ID NO: 400480 - DNA, 377 bp, Homo sapiens
gagatagtatcttgctctgtcgcccaggttgaagtgcagtggcgtgatgtcggctcgctgcaacctccacctcccgggttccagcgattctcctacgtcagcctcccaagtagctgagactataggtgcccaccaccatgcccagctagtttttatatttttagtagaggtttcaccatgttggccaggctggtctagaactcctgacctcaaaagatccacccatcttggcctcccaaagtgccgggattacaggcatgagccaccgcacccagcctactgaactttttgactagggaatttgttctctgttattgttttatggaaataagaagaagctaattcttatctgacatcaaagactccaggcaagataa

SEQ ID NO: 400481 - DNA, 601 bp, Homo sapiens
atgtactgcatttccatggagtaacatccacggctggctatctatggatgtaactgcattggctaagaacggtgaacacaaagaaactttaatgaaggcagtaaacttgccagtaacaggcactgtgcttccccagtactcaacaggctgatgggtcactgacagacgaggaggaacaacctgtcctagatatcattaaaggagattcttggcttgatggagagacaggctcccacaaaaagaaaaatgagaggatgttatggtcatgtattactaatagtttagaggagaaaatttgaaaatgtaaatgaaatggataaattactataaaaatacaaaatattaaaactgactcaagagaaaaattgaatgattcaaaccaataaacatcaaagaatttaaatcagtagttaacctttctattaacaaaatgtgcagtactgatgactttacaggtaaattctaccaaaaaaaaagagaagacaatttcatataaactcttcaaataatcacacagaggaaacactctttactcattgtatgaggcaagcttacatttgataccaaaaccaaactagaatacactaagcaataaaaacta

SEQ ID NO: 400482 - DNA, 423 bp, Homo sapiens
aaaccctggaggagcctgggttctttgcccacaggtcctggggcccttggtcctcctgcatggattcgtgagggagattcctgctcatctgggccactcaacagtggtccctgttgggccagggagtcactttggtgtctgaaagtccctgtggggacagtttatgctgagcccagttgaagcttcaggtttattttctgcagagcaccccagtgggggctttcctgaagagctgtggtgctgacactcagataacaagccatcatttatggcacactcacctaaactgggcaccgtggaagtgggttccaggggtagcccctcactgtgacatgcccagccttaatcttcctctgcatttgcaatggtgtgtagatgccctgatgttgaagctaaaatgagcccctgttttcaccaggaaaa

SEQ ID NO: 400483 - DNA, 672 bp, Homo sapiens
aaaccctggaggagcctgggttctttgcccacaggtcctggggcccttggtcctcctgcatggattcgtgagggagattcctgctcatctgggccactcaacagtggtccctgttgggccagggagtcactttggtgtctgaaagtccctgtggggacagtttatgctgagcccagttgaagcttcaggtttattttctgcagagcaccccagtgggggctttcctgaagagctgtggtgctgacactcagataacaagccatcatttatggcacactcacctaaactgggcaccgtggaaggggcttcccatacttcctcccaacaatcccatgaacacaacaccaacccagacaggtgggctctctggagagtccagcttgcagaggggaagctgaggcccaagccggctcaggttctcccagtgcttcccagccagaagcagcattgccagggctcgaggttctgaaccgggcactccagctgccccttccccatgccggagggcagcagcctggctccaagcacccctgtgcactgttcctgggaagtgggttccaggggtagcccctcactgtgacatgcccagccttaatcttcctctgcatttgcaatggtgtgtagatgccctgatgttgaagctaaaatgagcccctgttttcaccaggaaaa

SEQ ID NO: 400484 - DNA, 1248 bp, Homo sapiens
tgcgcgccgcggggggcgtcttacctgttgatcttgagcgcgaacgcgcggcgctctgcgctcggcagagtggccatggcccgccggcggttcggtggcttctagggtcgcggggtgcggaaagcgggggcctggcgcgccgcagagtagccgcggaacatgcccagccaagcgcaaacctcgtctgtcggtcggcgctggaaacttccgcatttccaccttctaagccgaaatcaccccgggggagggtccgagggcggagcttgcagtgaaccgagatctgccactgcactccagcctggcgacagagcaagtctccgtctaaaagaaaaaaaaaaaacaaccaaagcgaagtatttttggttcaaacctgcactatttaatatgatagccactagccacatgtggctattgaccactcggcattatggttagtctgaattgcccactgctggatgtgtaaaatgtacactggaatttaaagacagcgcagaaaacatcgtgtaaaatgtcttgttaatgattttcatgttgattgcatgttaaatgatactttggatataaaaaatatattattaaagttaatttcacctgtttgttttccccttttaaaaatgtggtttgcatttttaaaaatgtaaaattacacatgtggctcacatttgtgagcctcattatattcctattggacagtgccagtccaatacaacctaatttgtcacctaatactaaaatccacctaaggactatattcagtctcttcctgatacagccttcctttctggtttcagctgtgtcaggtagtttagtaacttttcagtactggttaggtaactccccgccccccaatgcccaccaaatatcagtgcccttttaagcatataagacaaagttcactgcatagactacaatagactacatatgaaaacaaacccaaagaaaaataaagcttttttgaaatttagagtttctgactttcaaaactgtccttatttactacattggaatttatgagcaaacatttggatagcaaaatacaaagagaacaaatgtgtaagtacttcttcaaactgagactcaacgaatgatacatagaaaacattttgccccagaggcttcggtccacggtgtaccatgtcagcctttcggatgaactcctctgagtttctgaatgtttatgacatacattttcatatagaacaaaaatatactggtttcacacaaacataaataaaatgtaatgaaagc

SEQ ID NO: 400485 - DNA, 615 bp, Homo sapiens
gctaatagcatgcgtgaggtggcatcccccagtccttaacttgaagctggacgatctgtgtatctcaagatgtcctggcacaggacaattgtttgggttcatacaagtgtaaattgcccgaaggaatcacttttgtcatgtatcatggtctccgtattggagccacgtgatagtcaatatatagcggatcgtcactcacaggagagctacacactctgtagctggaataatgaagcaggcgaggacggagccttgctcaggacgacagaaggcttgcagcctgcctcaaacgcaactctaatttcagccacttcacttcttccccccgcgctcagacttgcctcaaaggaagctccatctgcccgaagctgcgaggctgccagggaatgtaggcaagtcgggggagccccacaaagctggcgaggtcgggaatcaccccagggattcgtaaggctaggtgttattaagggttgacaccattctcgaagaaggcagccaaaaaaaaagacaaaaaagttagtggaatctatcaggattcaaatcaacttttgcaagcaatatgcccatcatccttcctgagacactaaataaatataatggattcatccaaggaat

SEQ ID NO: 400486 - DNA, 709 bp, Homo sapiens
tgcgcgccgcggggggcgtcttacctgttgatcttgagcgcgaacgcgcggcgctctgcgctcggcagagtggccatggcccgccggcggttcggtggcttctagggtcgcggggtgcggaaagcgggggcctggcgcgccgcagagtagccgcggaacatgcccagccaagcgcaaacctcgtctgtcggtcggcgctggaaacttccgcatttccaccttctaagccgaaatcaccccgggggagggtccgagctcggagcagcgacggccggctccgccacccggcctggcgcgcaggcagcggcgggcgaggagggcgtgggcccagcgcggaactggcctccggatactggggcagacggcgcgctctgcccggggccgccgacctccggccgaagggagcgcgggcggacgacaggcgaccactgcgcgcaggccggaagctccatctgcccgaagctgcgaggctgccagggaatgtaggcaagtcgggggagccccacaaagctggcgaggtcgggaatcaccccagggattcgtaaggctaggtgttattaagggttgacaccattctcgaagaaggcagccaaaaaaaaagacaaaaaagttagtggaatctatcaggattcaaatcaacttttgcaagcaatatgcccatcatccttcctgagacactaaataaatataatggattcatccaaggaat

SEQ ID NO: 400487 - DNA, 745 bp, Homo sapiens
ttggaccagggtataaaaatagcgatgccaccaggagccaagctctttctagaataatgaagcaggcgaggacggagccttgctcaggacgacagaaggcttgcagcctgcctcaaacgcaactctaatttcagccacttcacttcttccccccgcgctcagacttgcctcaaaggaaggagccgtttatgagacactccgtggcgcgcccaacacggttacccaggcgcctatcacccttctgggacccggccacctgtaagaacctggagggcggagcgggcgaggttgttcggggaagggatccccggcggcggaggacatccaggagcaccgagattcttggggaggacctcgccgggcccagcgcaggagccgccgcgcgtccagcggctccaccgccgcagcctcgggaaccgggcgccccaggtctcaggcgcgccccgccgcggacgcgaatggactcgtccggcctcggcccctgcagcgaagctccgcttcacaccagcgctgggctgtccggccgcgacctgcgcgccgcggggggcgtcttacctgttgatcttgagcgcgaacgcgcggcgctctgcgctcggcagagtggccatggcccgccggcggttcggtggcttctagggtcgcggggtgcggaaagcgggggcctggcgcgccgcagagtagccgcggaacatgcccagccaagcgcaaacctcgtctgtcggtcggcgctggaaacttccgcatt

SEQ ID NO: 400488 - DNA, 608 bp, Homo sapiens
gtgatggcgcatgcctgtaatcccagctactcgggaggctgaggcaggagaatcgcttgaacccgggagccggagggtgccatgagccaagatcacaccattgcactccagcctgggcagcaagagcgaaaattcatctcaaaaaacaaaattagtaggacctggtgagatgcacctgtagtcccagctacttgggagaccgagccaggaggatctcttgagcccaggagtttgaggttacagtgaggaccactgcactccccctgggtggcagagggataccatgtctaaaaactacaatcaaaaaaagccttttttttaaaagttactttggttttaaggaataagaagccttgaaacactcagccctggactgaatcctccaggcaccagagctgtgctggtctggacccttccaccccacttgaaacctgttggccctgttgcaaccctctcttgctttccctgagaaccctaaggtgaccccaggggctgctgatggagacagtcacctccttgccctgctccctgcagcctctcactttggctgctttgctatcataaggaaggaaacataaaagctactttttagcattacaaagttaaaa

SEQ ID NO: 400489 - DNA, 266 bp, Homo sapiens
ttatatatttcaaaatagctagaagacttacaatgttcccaacacaaataaatgataaatgtttgaggtgatggatatcttaaatcctctgatgtgatcattacatattgtatgcaggtattaaaatatcacatgtactccataaatatgtacaattattatgtatcaataaaaatattttaacaccccaaaatatgaggaaagagatggtttcagaagcaagaggcttcaataacccatgaactaaagaagtcaaaatgagtaac

SEQ ID NO: 400490 - DNA, 341 bp, Homo sapiens
accctgtggccgtgggcctcgatgagggccacagagttaccaaaaatgggagcaagcctggcccagccaccgccaaagtgggcaactgaccaagcacaccaagttcatgtgggacattattccaaagatgtatggctttactccctacgagctggcgcgccatggagttgctcaaggtttccaaggacaaacggccctcaggttcatcaagaagagagtgggggacacgtccgcaccaagatgaagagagaagagctaagcaacgccctgcccgccatgaagaaagtggccacaaagaaggactgaggccccataccctatccataaaaccttcacagaaa

SEQ ID NO: 400491 - DNA, 262 bp, Homo sapiens
tgcagtcccagctacttgggagactgaggtaggaggatcgcttggggccctaaacattaaggcttcaatgagtcctgattatgccactgcactccagcctgggtggcagagtgatagggtctcaaaaaaaaaaaaagtccactgaaacaaataaatgaaaataaaaagcataatattatccaaaaatgaaaaataagttacagggtacccaaatgagaataaactcataataaaacttaattaaaaacattgaaaatggcgg

SEQ ID NO: 400492 - DNA, 362 bp, Homo sapiens
tgcaatgagcagcaggtaaatatctttttagtgtctttagccttagcttgtctgtgtgattttccctacatatgtatagccagatttcagcagtttttacacaaaacttggggctttccactctcagactcccttttctgggatttcatctttctatttctaactttcatggttgtcccaaactcttgtcttttggttttcccaaccagtgagaccttgggtttctatccagattttaaatgtcccatgttgcattgactagtgaaaaatcttttttaaaaaacccgttgcttgagcctgggaggtcaaggctgcagtgcgagctgtgatcgcgccaacttgcactccagcctgggtgacag

SEQ ID NO: 400493 - DNA, 240 bp, Homo sapiens
gtaaccatcaggaagtggaattgctgggccaattgtgaacattctaagtctcatactcgatatttttgagtaactaaagttgaaatggttttgtcccatgactgagatcatcaagcttgtgacttgtagagcctttacctattgtctaccctctttgtgttcctaactctaccatagtgggtccagcccattgtgggtgctcagtaaatatttgttgaataactttatgaagggaagaaa

SEQ ID NO: 400494 - DNA, 178 bp, Homo sapiens
cagttttacagaggtacagattagtgaaggaatttatccaaggtcacacagctattaagtggtaaagcaaggatttgaatttaggcaatctgagtccagagactccattcttaaccactaaactggatgtggtctctgcagagagtcctgtctcatagggagacagaatagatgaggg

SEQ ID NO: 400495 - DNA, 499 bp, Homo sapiens
agaggatgactcctctctcgcaggtccaccttctttggtgttgcttgagggatcagaagaaatgccttaacataggtgtgtgggaactatggctgctaagtatgaactcagttacctccagttataagctagtgtgaggttccatggtgagcactttggactctgaattcagtgatcagagttcaagtctcactggtacctttctgtataattccagtgaggttcctctctattgctccataagcagaatgggggaaattgcccaatcgtggtcacagaccctccatgccactggctgtatgcaattggagtcccggacccagcgaccagcaagacccctcccctctcagggtgaccctgggcctccaggtcacaggtctccactaaaaatgctgcctcccctcaatcctagaccccgagttttcttttgttcacgtcattgggccattgccctatgtctctttggaagaaatgacctatatgaaaaattttacttcca

SEQ ID NO: 400496 - DNA, 343 bp, Homo sapiens
gttgctactaaatggattcaggtttggtcaggtttgcgaataaattagttacaaaaatcagagtcttttggatcttggaactgtggaaactggattgtggacctgtacttgactatgataagcatttctttttttctttttttttttgagatggagtttcactcttgttgcccaggctggagtgcagtggtgtgatcttggctcactgcaacctccgcctgccgggttcaagggattctcctacctcagcctccctgataagcatttcatatacatctttgcttaccccaagatagccagctgcataaaaatcatgatttttaaaaaatgctgtagttaaaaa

SEQ ID NO: 400497 - DNA, 306 bp, Homo sapiens
tctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattctttt

SEQ ID NO: 400498 - DNA, 417 bp, Homo sapiens
ttattaccatcttgggaacatattcagaaatgtctttccttccctccctccctccttctttcccatcctttcttccttctatttattttccaggcaggcccatttgtctgcttagattcagtgacacagaatgggtccaggaccatgtcaagaccacctgctgatgctagtgttagatgactccaggaatgtgaggtgtgcatccatggtttcagaatgtaatccgtgttgacgtgtactgtttgcatactctcagactgttttttttttatgcaaaagaaatgttactttctgggggaaaaaattaaaagtctatctttcatcaacctaaaacttctatatcccccaaacatagaagtttacctttttaacatttttctctcaacctgtacaaaaataaaaaaattctacattatg

SEQ ID NO: 400499 - DNA, 551 bp, Homo sapiens
cagagtgtgactctgtctcaaaagaaaaaatgaaaagaaaaagttgttcgtagatagtggaaggttttgagtcttcctatggcagtatgacagcataatgcagtgtgtaggggtaaactttggagctacactccttgggtttaaatcctggccttcctatttatgagctatgtgacattaggcaagctatttaaccatttaatttccttatgcctcagtttccttctctgtaaaatgaggatgataataataagccctctcacaggtaattgtaaggtttaaatataaatactttagttgttattaacttgaacactttctactcactcaatacccttggccacacagaatgccttcagttcctcaatgtgccacattcttcttcccccagagctgccattcaaattgtcttgcaatctggaagattatccctcctgttcaccttactgactcctccaccctttgggactcagcttaaaaaccccctcctcagaaatgccttctcagaggtgtctctgaaataggcctcccacaattactctttcctctac

SEQ ID NO: 400500 - DNA, 675 bp, Homo sapiens
gcctaatgtaatgaaaaatattgctatctctccactgattattttggatgatgggagagctgtatagccatttaactaaagaggaatcctttcaggaactactctgaagtactttaagagatggagttgctgaagaaaaaagattgaaaacaattggcttagctgttcggagcgtggcaagaatgtaactgtaatctgtcattgtgtgggcagacaaattgcctgaaaattgaataaattggaaatcactggaaggcagctattttgtccttgagtgcattagatatcttggaaaaatgttattaaatggtgaacaattgctatcgaaaagtttctagttgtttggaatatagagttacataaagtcaagattctattattattctaataatagataaaatccgaatgtaaagaaaatgtttcctatgaaatatgtaatttaattcttctcagagcaatactttaaacaattatttgattagcctgtgtttgtgaatgtatataaagtaagcaataaccttattttctcctctttgtaatttaattcattagaaattgagaatctcagacttctctccagccctattaaatctgcatcttcatttccaggtcactcatatactgtttaactttgagaagcactgctgtatattgtcttgagagtccacactatga

SEQ ID NO: 400501 - DNA, 420 bp, Homo sapiens
caaagggagcctcccagccagggtccacggccgcccatggagtggcctgagtacatcttagtgtgaacactggagaagccccggtgagatgccgaggtaggtagttgtacgtgttggcttggctaggctgagtcaaacactaatctaggcgctgctgtgaatgcaggtgctttgtagatgtggttaatgccacaatcagttggctttgagtgaaggagattaccctgaaaatatgggtgggcctcctacatcagtggaaggccgtaagagcaaaaaccggtttcccagagaaggaattctgcctcaaggctgcagaattcactccccggagctgccagcaacagatttcaggcctgccagccccccgcagacacgggccaagtccttcaaataaatctattggttctgtgttcctggaga

SEQ ID NO: 400502 - DNA, 498 bp, Homo sapiens
ccttggtgctgtctacagagacaaaaataaatttctttggattttagttatctttctatgtcagagattcccaagaccatccccaggttgacgatttgctaggaagactcacaggactcagcatatatccatattcatggttatgattcattatagggaaataacataaagcaaaattaggcactctccgcctggcacatactaaagttacatactcccagaagaaaagtagatgtcagcataaaccgtattgtttgtacaaacaatctaggcatagtgagtcactcttatttagggaattgtggaatccctcctgaaatctaagttcacaggtgccaggcaaaaaggcccttttaatcatagaagcctcaggcctgctgtgataactcttttctctacatgtttttttttttaatttatacaatgatttgcaggtaaaatcaagagtccacatatcaagtaactgtcttttaaatgttattcatatatttacaggta

SEQ ID NO: 400503 - DNA, 625 bp, Homo sapiens
cacaaatttatttctcagaatgcaagtctgtctcttatatcctcgggaaacacacctttatatcccagttagtactggccaaaattaaactagggactggccaaaaacagtgcctttcctcactttaatctcactaaagtagataagactcaagttattttgttcttgcaatggcattgacaaatgtttgcaccaaaaaccatgttgaagttcattaaggaaactgtgatccaagatccaaggtcaaaaaaacaaattcatcaattcagcacaccaccaactcacaggctaagcatcttactgctaattcattgatgctgccatttgtcaagtgccaaattgaattattgatttgtcaataatttccttccgttggttacttatatagtatattgcaattcttgttgctgaagtcagctacactttttctatttgaaaaacaatttcttgcatttgggatttcaggtatagtgattgttacaaatatgaaggacttgaattaacagcaagttttcaagtaaaactttacttatgtataactgaatgagttcttaaagacatttactaacaattttccacaaactaaaaatttataaaacaataaataaaatagactttaaaaaaa

SEQ ID NO: 400504 - DNA, 159 bp, Homo sapiens
cattccagtgaaatgaatggaatggtaaaaatattcttcatatacttacagcagcaaaatagttgttttctttttggaattctttttagctgtcaagtgaatataacaaaattgttttctttttgttattcagggaatttctataaattacgttcaggg

SEQ ID NO: 400505 - DNA, 118 bp, Homo sapiens
gctgttggttggccatgtgacctacatctctcctttaggtctcaggtgaaacatcccctcctcccaggatccttccctgattcccaagcatgggaaggaggaggaacctcctttggtg

SEQ ID NO: 400506 - DNA, 474 bp, Homo sapiens
gtgacaccctggagctccagtttcttcgtttgcaaaatgggatcctcagagacacccacctggccctttcacaacagcagccagcacgttcctgatatggcagacaatgctgtgtgcaacacatcgtctcctcatctggacacgcgacaatggtgctcccagccgccctcacagtgagcctgggcacgtgacgttctcgccaacggacctcgcacagaagcgatgtgccacttctagtccaaggcagagagtgctccccgacccatctctcttctctggctgcagttattctgaggcctctgattccggcctcaggcagcctggattcctgcactggctgggaggaggcccatccagggggccttttatcagactgtgacatgtgagcaaaaaagagactttttttactaagccactgagacagtatcaatgactctgaataagacacctaataaaacaaaagtcaaatcaaat

SEQ ID NO: 400507 - DNA, 499 bp, Homo sapiens
gtgacaccctggagctccagtttcttcgtttgcaaaatgggatcctcagagacacccacctggccctttcacagtgggttgcggttggcgctgttgggacagcagccagcacgttcctgatatggcagacaatgctgtgtgcaacacatcgtctcctcatctggacacgcgacaatggtgctcccagccgccctcacagtgagcctgggcacgtgacgttctcgccaacggacctcgcacagaagcgatgtgccacttctagtccaaggcagagagtgctccccgacccatctctcttctctggctgcagttattctgaggcctctgattccggcctcaggcagcctggattcctgcactggctgggaggaggcccatccagggggccttttatcagactgtgacatgtgagcaaaaaagagactttttttactaagccactgagacagtatcaatgactctgaataagacacctaataaaacaaaagtcaaatcaaat

SEQ ID NO: 400508 - DNA, 359 bp, Homo sapiens
  misc_feature (168)..(168): n is a, c, g, or t
acattgtaatataaagtctttgaatcctcacaatgaccccaggaggtaggtgctgttattaacatcgtcctttcctccatgaggctaataagacacagagagattaagtgtcttgtccaaggtcatagagctagaaccttgactccagaaacagcatctgcaaccccncctaaccccccaccctcgcggccttttgcctattctgcaatctcatgaaatttcctttccttctttgaggccaggagctctccaaggtgctggagagaggcccagaagcagcgtagagaggcagccccgccagaccctgcaagaccatagtaaggaccaggattttattttgagaattaagggaaaccaca

SEQ ID NO: 400509 - DNA, 302 bp, Homo sapiens
ggccaggaggcgctgggagcgggagtgctcgccctggggaccgcccccttttcccttttagggtggctcctgtcctccctccccatccctgacctggcgaaaggcctagtcctggggaccctcccacctcaggggctgcaggcggactgccccagctcccccagccccacgaaactgggcctttcctgctgagaggaagtgactttttacagaagccactgaacctggttattttggcaaatcgtccgtctcgagggccttggggggaactgaaatatacagcctgaacgttaaaagtgctc

SEQ ID NO: 400510 - DNA, 484 bp, Homo sapiens
gtcatccagccctacctcccctccaagcagggtcacccgtttctacattccattgcagcagctggagtcctggatttgccactaacacaccccacgtgcccaagcacagtttcatcttctgcaaaatggtgacactccttaaagtttcttcccatccgaaagttctgttatcaatacccactcatccaacaaatggcaagaaaatttagcttctccttaaatccatgctaatgtttatgagcataagaacccaaggagatcctccttacatagaaggcaagcatctaaatcaattcaactctacttttatcttgcattaaaagatgaagccaatacaaaaattagctgggtgtggtggtgcacgcctgtaatcccggctactcagggggctgaggcaggagaatcacttgaacccaggaggcagaggttggagtgagctgagattgtgccactgcactccagcctgggcgatagagcgagactc

SEQ ID NO: 400511 - DNA, 434 bp, Homo sapiens
gaaatatgtccatgactaatcattgaaacctgggaatattgcctttatatggcaaaagggactttgcagatgtgattatgttatggatttttagatgagattatcctgggctgttcccctgggcctgatgtaatcatactggttcttaccagagagatgaaagagtcagtcagagaaaaaaggcgatatgattgtagaaacagactggagtgatggactttgaaaatggaggagggggcactagtcaaagaagacagatggcccctagaaaagcaaggaaatgggtgctcctgagagcctccataaggagccagccctgccaacatctttgctttagcctgctgaaactgatttcagttttctgaattctagaatataagagaatagataaaccacaaatttgtggtaatttttacagcagcaataagaaacta

SEQ ID NO: 400512 - DNA, 412 bp, Homo sapiens
aggaagtctgtgtacataaaatgctggtcataccctggatttatttcaaatgcgttgtaggattgtcagatcaacataggaatttttgtttcaggaaaatgggatcttacagggtaatgtggtgagatgatggattctgaatatttcatttcaaatgaaatcaagtgatacaagatatgatcctcccttcacaacaagggaacttggagggaggagaggaaagaattttcttaaaactcgtagttgcatgtttattctccccttgggtgccctaccctatcttctaacaaatcagaactactccttgtgccccgcctatcctcagttttcctgccttccgctaatttgttcaaactactccctctgcctatgtgaaaagactgcccgtggaaggcagcgagactccgtctca

SEQ ID NO: 400513 - DNA, 308 bp, Homo sapiens
aaccaaactgtcatttcaggcttgatctcaggaaatttacctcccacacacaagttctcaggaagctaattaaaaaggtaacctacgaaaataagaaggaggggtccagaaaactagaaacccaatacctgttagaagtaaaaaattctaaggatgacgggaaaaggaattttaggagaacagctatgcaggagaccaaagagcaatcagctcagattggagcaagaggacacacatctccaaagaggtgactctgccaagacgaatttaacgtttgaatggactgaaaggagatttatccttccatg

SEQ ID NO: 400514 - DNA, 238 bp, Homo sapiens
  misc_feature (1)..(1): n is a, c, g, or t
ntctagaggatccctggcaaggtggaaatcaggatttatttcatgggctctgtcacagtctcggatggcagcattgggcttctcgtatttggggaaggggatgttctgcacagtgcagtactcacaggtttgtttcaggggctggaacagcacagagggcgtgtttgagcattaggaggagtgggagtggaggagaagcacagagttcttagccccagcttcctgatttccccagcta

SEQ ID NO: 400515 - DNA, 482 bp, Homo sapiens
tgtgtcactgggaacttgagaattcttttcttaactagtcggggaataaaaatctcttctaaagcccgtgtttttggttacccgggggtgtgcctctttgaacacaggctcaactgctaccagggaaggctggggggcagctgcactgctgtgtgaatcgctgactcactgggttcaaaggaaaccagccgctcttctatatgtgttgacagcaccctgtgagcaaggtgggcatccttaagacctgctggactttctgctgggggcctggctggcttcagccttgcacagggacactgggcatgaaggcagggagctctgcagttcaggactcggggcaggagtcagggctggttttctcgaaggtggacacaccacccaccccaggactcaagcgatggtggcctggacctccagttctaagcctcatctgtttttgttttattatctatgatttgttataaaatcttgaaggcatgtta

SEQ ID NO: 400516 - DNA, 619 bp, Homo sapiens
gggagatagtaaataataataataaaaccaatagctttcattatttgtttttttttaaattattttattaataattaaggtataattatcacatgacaaaatgcactcattttaaatgaccaatacaataaattttgacaaatggatatactcattaacacactaactacaatcataatcaatatatggaacatttccatctctcctaaatgtctccttgtgatacttcccagggactccctccctattccccacccctatctcccaccactggacccaggcaaccactgatttttcttctattactttagattaaacttagtctttctagaacttataaataaaatcatatagatttattcttttgtattctggctcattttgctcagtaaggtgtttttcagatttatacttgtgatggcatgtatcagtacagtattttgcttctttttattgctgagtatgatgctattaatatggatgatacaaaaacttgtgtgtctgttcaccagttgatgggaatttgtgtggtttccacagggtttgggcacctattcacttttttaatggcctaacaaggctccaagtagacattactatggcttcttagtctttcccg

SEQ ID NO: 400517 - DNA, 320 bp, Homo sapiens
ctaccagtgtccgtggttcttccagagtgccttttgtaagctttcccctgggatctagtacatccatcacctctgagctccattcgggctgctgataaaagagcaccagcattgaaactggccagagtgaaggactgatctccagtcctttcctgttcctgccattttctccctaaactatgctacttcctgcatgctggcttgagaagcacaagattctaaattaagcaatcagataaaaaggaaaaatacagaaaatgtcaaatcctgcttggactagttttataagtaagcaggtaaccaccaatatttgatgttaa

SEQ ID NO: 400518 - DNA, 520 bp, Homo sapiens
tgaatatggctttcttttaatgcatctccaggatcacttttctctgatctagagtctggaccacctcaggggacaaagcagagctgtcagggaggtgtggacaggagcaggaatgatgtcagattaccagctgcttgcaggacggttgctgggtggctgtggactgacgcggctcttctgccattctcacttgtagttgtcaagaataactttagactttgctgggaatgcaatatcttctgacaaggaggagttggctggaacagcctgggctctgtacctgtccctcagatgtcctttggtgctttagcccagtgactcatcgatctcccaggtataaaacccagggtgggcttctttctggggtccttcggctgcagtacaagtggggcatgcacagatgagactccatctaccctgggaagctctcctgagccttgggggactggcttgtcatgaatccttggctttagttgtcccttgttgtgtatttctaatgaataaacctgttgcatataaa

SEQ ID NO: 400519 - DNA, 567 bp, Homo sapiens
gtatgggtattctacctacaggttttccttcactgttgcccttttcaggaacaagacttatctctcacctagcctaaggtaagggaagaaagtcggaggctggctttggctgcgaaaagagaaaaaagaaaagagaagagaaggaagaaaaaggaagaccaaagaaggaaactagaagaaattgaagccaaaaataaagagaactttgaactccaagctgctcaagaaaaagaaaagcttaaagttgaaggggatggtttccaggaccctcacggataccaaaattcagatactcaagtctttatataacatggtgtaatatttgcataaaaattatgcacattctcccatatactttaaatcatctctacattacctctaatacctaacgcaaatgctatgtaaatagttgttatactgtattttttaaattcgtatttgttttttgttttgttttttgaatactttcaatctagtgttggttaaatctatggataaagaggactgactgtattgtgggaaggaacccctgccatgaaaccaccaaaaataagtgcatgcaaaaaa

SEQ ID NO: 400520 - DNA, 618 bp, Homo sapiens
ggaggattctcccctaagcccccctcccttgtttggccgcggaaaagggctttcaaggggtactacgagcaattatattggggaccgacgagacccccgcgggtacgtgactgggaagccatttgacagctgtagcctaatttcagccagctcaacaggcaccatcgctagacctacggcgacaagagcgaagactccgtttccggaatataaccagaagaaagtaaggtacatcttaaacttgctcctcttatgatgaaccacatagacataactagtgttaatgggggtcagtggaagtcatcatgttctgaaaatccattaaatgtacatcattctagtgtttaggttaatgctgttaaattcctgttactttaagaaagggttggccgggtatggtggctcacgcctgtaaccctaaccttggggagacagagatgggtggctcacctgtcaagagttcaagaccagcctgggcagcatggtaaaaccccatctctgctaaaaataaaaaaattagctgggcatggtggcgcatgcctgtaatcccagctactctggaggctgaggcatgagaattgcttgaacccaggaggcagaggctgcagtgaaccgaga

SEQ ID NO: 400521 - DNA, 339 bp, Homo sapiens
caaactgagaagaggctatgggaagaaatggactttcctatttgctattaggatctcatgtccatccttctctacctgcctttgcatcctgggaggagacatgtctgtgcctcgtcaatgggctgtctttcactcaggctccaaagggtacacattgacaggagattggagggtgactttttttttcagccaaagggacacattgacagtagattgggggatgattttttaaaaatttcctggctctctccctgcgccctgaagggctgtgagttggcagtggcagtgtttttctacctaaggacatagccctgcctggtggccctttcctgtagccac

SEQ ID NO: 400522 - DNA, 518 bp, Homo sapiens
tgcctgattgttcatttcatcgatggccatctgtagctacatcttcttaaacctgggtgaccccacatttcctggaaccttgccatagcaccagcccctccacaatgggattggagggaaggctactcccagcgtatgctggtagctggtagcagggcttcatttcagagttatttccttatctcgcagccccactgcacagacccctgcaacagcctcctgattagcactaccttcctgttcataaatgcaccacaccaggatttctctgtcagcctgcgaggcattcacttcctcagcccctagggaggggtggtggaaatacacacggccccccatcctctttagtaatccaacttcaagtgaagatgtgaagtccactaatttttttcctccacatcttatttgtctctttgcttggcaaatgtttcaatgacttaacagatgggattaatttttatcagatgtgcaagggagccatttttagtttttgctaaataaaaaaacagtggagtaca

SEQ ID NO: 400523 - DNA, 380 bp, Homo sapiens
ataatatccggtgagcctctttgaattttgaaagcaacatattcttcatttgggtatgctacaaaaacctatttactgagtgaccccaaagctgctaattttgactggagccagaaaaaaagaaggttctgcagcaggtccaggctgccgtgcaagctgctctgcgacttgggccatatgatccggcagatccaatggtacttgaagtaacagtggcagacatggatgctgtttaaagcctttgctgggccttagagctgactcacagtgcaggcctctagggtttttgtgaaagaccctgacagcaccttaatcttggacttatagcctccagaactgtaaagaataaatttctattgttttagacacctagtttgtgg

SEQ ID NO: 400524 - DNA, 192 bp, Homo sapiens
gttcaccagtgttgtagatccttgggcatttttagaagtgaaggtctgcctgtgaagatttcctagaagcttctgccctctagcgcccagcctgagaggtagtgtggcaccatccctacttatccgtgcttccttcctcaatttacaaatcgtgattcagcgtgagaaaatgataaagtcagcaggatggag

SEQ ID NO: 400525 - DNA, 407 bp, Homo sapiens
catcagtgatccccattggcaccatggaggacacggctggtggccccaaacagaagcccaccacaccatgattcaagcagacaagggaactttttgactccataatggaaaaattaggggttgaggcctggcgcggtggtgcatgcctgtaatcccagcactttgggaggccaagttgggcggatcacttgaagtcaggagtttgagaccagcctggccaacatggtgaaaccccatctctactaaaaataacaaaaattagccaggcgtgttggtggatgcctgtaatcccagctactcaggaggctgaggcaggagaatcgctttaacctgggaggcggaggttgcagtgagccgagatggtgccattacactccagcctggtgacacagcaagactctatctca

SEQ ID NO: 400526 - DNA, 405 bp, Homo sapiens
gcttcttatggtaccacaggaggaaccttgcatccaccttcctggaagcacatactgaccacatggagtgggcttactggtgtggtgaagctctccagagccctacaagtgtgaccctgggctagttacttcaacctctctgagagtttaatttctccatttgttaaatagatagaggtttgttaagtgcttagcacccagtgaatgaccctgcttctggcttgtattaggacttttgcttaaagtcactttacctctgtgtctcacttgcctcatctgtaaaatcgggctatttgaagcaatgagatgaaagatgggatagtatttttgttattcctgtttatcttgagaactcattgtttgatatatatatatatatatatatatatagtcctcaggtgacct

SEQ ID NO: 400527 - DNA, 664 bp, Homo sapiens
gaggttttattatctgcctgcaatctgcaatagatcctcaatttttctagtttactacaatatttagctacaacactccaaattaatatttcatttttttcctgctattctggcttggaatcactaaaattataaacttttcatttcttgaagtccttcaaactgaaactggatgacttgacataagcttcagaaaaattaccacaacagcttgtgtgtggcccatctttatggcattcaaactgcaaactaatccaatgcctcttctcacaccagctgaagatactacaagcccagcatctagaaatcttattgatcagctgccctctgggctcagaaactgtctttatagttcgttccaactattaatcttttttaattttatttttatagaaactaaacttcccacattaaaggcctgatagctcacactatccaggaaatatcctctgctaccaagtcccaacagatgattcaactggtccttaatgaataaaaggtgatcaaacaagaaaagagacttatattgtttgaaggaaagatgaatgtctcttctttccttaaacaagaagtagtactaacaaagattccttgcttggccaaactttagtcagatgtctatcttccttgcaaaatccaacttttttttttttatgtggtacaa

SEQ ID NO: 400528 - DNA, 436 bp, Homo sapiens
cctctagcctgggtgacagagtgagaccctatttcttaaaaaaacaaaccaaacaaacaaaaaaagactcttcatgttagagaataaatatcctgaaaatgttttaaatatctcttcatattagagaataaatattttgaaaatgttttaaaggaaagagaggacttctagtttcagactaagatggagtagacacactcctctctattcctcctgttaattgtagcttaaaactttgcacattatatgtaatatacatgttaggaaatatctgaaaagtggagcgaaggcagcagactgcctagggactttgggacacaaagagggacacagcagttttctttttgccttatacgtaccagactggatgctagagaagatcataaccttgaaaacaccaatggaagataaaagtttcccaaaactttgctctatc

SEQ ID NO: 400529 - DNA, 494 bp, Homo sapiens
cgttctttcctagccccggactttcagaactagttgtggggagaactgctgggccaagagacaggtccgagttctgtgtaggtggcatgaaggctcctgcctccaggacatgaggcggggctccagtgaggtgttggccctaggggcaaccttatcctgcaggggttcttaacccgaggagaggtaattaattcaagagtactgtgaacttggatgagaaaaaatttacgtcttaattttcaccaacctctgacatttagcacgttttgccattatgaacgtagacaacaaactacagtagcagtaggataagtatttatgacttagtaatcactagaaaccataggtttttacatcacatcacagttgttgcaagtatctcaaataacagtagttattagacaatcagccagatattatatgtcaataatgaagcatatatattgctctagcacaaatttttaaaaacattttgttagctacaaaaaaaaaaa

SEQ ID NO: 400530 - DNA, 460 bp, Homo sapiens
tccggtctctatgtcggactacgatcagtctgagaccttcgcccagatagaactgaccccaaactgacaaagggaaggtcagtgccagcctttgtgaaggcttcctggttggcctgaatttcctgctcccttcaggaagggtggggacaaaggagaggcccccctgggggcaaagagggaaatatcagaggttgcctaagaaaatgccctgctggaaaacacaaacccgaagggaagtttgggctgtaactctggtggcagggtgaccaagcgcagctgcttgaggaagccctgctgtgcctcaacaggatgtaaactcattgtgagcaacactttcctgctctctgtgaacttaaagggcagaaccagcaggtcctgccccaaacagtccctgccttagagcagggtggtcgggatggcctggacagccacagcaattaaaaaattgcaacattttaaa

SEQ ID NO: 400531 - DNA, 644 bp, Homo sapiens
atccagcccagggcaaaggttacattttagtcatctttctcctctgctagcttattagcctcattcacccagggtaatggactcttctgttttcttttctgctgtacccctcgttcctataaaaaatacccggtgcataggagacatatagtgactatgttaattaatttgagttgaagaatagacaagtaattcagagtctacagtattagcatggtttttgtctctgaacacactggagttttgttctcatcttggtcttgcaagtcactttagcttttttctgtcttacgacttttcagttagctcctctactgaaacacattattagactcttatatccatttttctatttttcattaatgaattaacacctgggatctaaatttttctgtttcctcatatacaaatggtaagctaatgtcagttgcagcaaagggtatatttactaggatttggggacccaaatcctcttcatgctattgggaatgatatttattcagactgggatttgacctgttttttgtctctcttctcagtttctttgtgagttggttaactttttcatacagtataggtcttctcagttacatgattctacttacatctgattttaataattgtgctggtctgttatttttaag

SEQ ID NO: 400532 - DNA, 397 bp, Homo sapiens
ggtgaaaccccatctctactaaaaatgacaaaaataagccaggcgtggtggcgggcacctgtaatcccagctactagggaggctcagggaggtgaatcacttgaacccaggaggcaggggttgcagtgagccgagatttcaccactgcactccagcctgggtgacagagtaagacaacatctcaaaaaaaaaagatccaagggaaacagatcaaagtaacacttcacttttatgaaggaaataagtgatggtcaggcagtcttctgggcataacagaaacccagaatccttcagccagatagtcaatgtcaaggccaggtgccacggttcatgcccggaatcctagtactttgggaggctgaggtaagagaactgcttgagactagcttgggcaaca

SEQ ID NO: 400533 - DNA, 488 bp, Homo sapiens
ataataataataataataattattattattattattattattattatttaaaaataattaattgccagatgatttgtattgattcctagaagggagatagcattttatgctggaatgcttaggggaggtatcatgagaagatttctctggttggacaggatttagatggagaacggagaagagggtatttcagcatgttattgggggttagcagacaaactagtttgactggagtaaaaatttatggactatagaaagctaatagaagggaaaatacgtatttaggagtagaatgcagagaatcttggatatcagggagtttagacatcaacttgcaaagcaccatagaagatttttgagcagaagattaaaagtagtcctttaatgaaggagaatcgcctgaacctgagaggcggaggttgcagtgagccgagattgcgccactgcactccagcctgggtgacaagagcaagattccgtctcaaaaa

SEQ ID NO: 400534 - DNA, 712 bp, Homo sapiens
ataataataataataataattattattattattattattattattatttaaaaataattaattgccagatgatttgtattgattcctagaagggagatagcattttatgctggaatgcttaggggaggtatcatgagaagatttctctggttggacaggatttagatggagaacggagaagagggtatttcagcatgttattgggggttagcagacaaactagtttgactggagtaaaaatttatggactatagaaagctaatagaagggaaaatacgtatttaggagtagaatgcagagaatcttggatatcagggagtttagacatcaacttgcaaagcaccatagaagatttttgagcagaagattaaaagtagtcctttaatgaaggagataaacttagtggtggagtacatagttgagtaaagcaggagagaattagaaagaccagataagtgggggcaaaaaattttttttggtgtgtgtagactttagcccatttgtccttcttctttctattctatctggtctaatatatacaggtcccaaacaacacataatgcttcccacccaaaatccacctctgtgatgggactagcatagtctgccttgactgaatgtataagtgacttaaatggttggtttaggcaaacaactggcgtgagacattttcttttctgaaccaacatgttgtatggctgaattgggttgg

SEQ ID NO: 400535 - DNA, 439 bp, Homo sapiens
tgagactcaaagagtcactcaaactcataattgcgtgtgtgtgtctactcattctccctctatctctccaataaccctttgagactcagaaactttttatccacatacaccctttatcacattttcttccccccactacatgtgtctcactttctctctgtatctgtctcgcttcttccgtctctgtcctacagcttggcggtaactgacgacctgtgagcttttagctgcaaactgcaactacgcggcaaacaatttatttagcccgacatctagccggtctccggcaggaccctgcaccgcgtcgggatcggacccttccgctggggcggcctcctgcgtcaaggccagcaggaaccttcctgtcgccctccccggccgccgcttcgcctccttcccgcccccggaggttgtgcaggcgctatggtccgcctggagg

SEQ ID NO: 400536 - DNA, 506 bp, Homo sapiens
acaataaacaaaagtttaagcaaactataattatatccaaaaaaaattattatgcatctcttaaaagggttacatagtatgacaaacatgcgaaaataattttgttaagccaaagaagaatgtaaaattgtacataatatataattacaactatatctgattttttttaaaaacttaggcatgggaggaaaaaaggagcaagaaccagtacaatctttctattctttggcagtatataccaaaagcttttaaaatggtgagattcttaaggccaggcggagtggctcacaacactttgggagccagattgcttgagtccaggagttcaaaaccagcctgggcaatatggcaaaacccattctccactaaaaatacaaaaattagctgggcaaagtggcgtgtgcctgtagtccctgcccagctacttgggaggctgaggctacagtgaaccataattggtgctacgtgcacttcagactggcaacagagtgagaccctgtctcaaa

SEQ ID NO: 400537 - DNA, 418 bp, Homo sapiens
aagctctatttcttgttcaagtcgcagtccattgtgggttcataagggatgagaggcttctgctccaggctgtcattcagggaccaaaactgcttttatctctttgccttggaatctgctgtgggaacttatacaacctgctggaagaaaagacagtgaagacacacccatcctcagctctggagtggcgctccccttccagtggtgagggctaatcatgtggcctgggctcagtgcttgaggtctgggaagtatcgtctgaacccaggaagaaatggccctcgcctcagctgctgataacaggccgtagttaatgacagatcatgatcatcaagtatcgccaattctcggtggaagttgggtttgtatttactttgtacagtttttactgattaataaagccagtggttgcaaatta

SEQ ID NO: 400538 - DNA, 1504 bp, Homo sapiens
atttgagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctcc

SEQ ID NO: 400539 - DNA, 1066 bp, Homo sapiens
atttgagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctcc

SEQ ID NO: 400540 - DNA, 678 bp, Homo sapiens
atttgagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatgtaagtataatttttcataaacaattttatttcaatatatccctcaagtttaccaattcaaattcatattttaattgagaggctgacttttctttctttgaaactaaactgtgaaaacaatccattaaaaagctaaat

SEQ ID NO: 400541 - DNA, 487 bp, Homo sapiens
ccctgtgaatagcttccttgacacccaataaggtcaattagactgcggttgcatggatgccatctggattttccagaaggatccagagaaaacgtagctggataccagacatcctgctaagaagaaatgccttaggggctgggcccagcaaagtgtctaccgggagtagttgacaagcccagttggagagagattctaaatcattaattttaagccactggaaattaaaaggtcaaaactgggcaagtggcaacaaagagactttcaacctgaaaactggtcatcatttcaaaagccccatttggaagcaaaccctgggattatcaaggagagagccaagcaggatgagctgcaatggtggtggagacagagggtggatgtcttgacttaaaaacatagagctacataaacaccccttggtcttctgcttaccaataaagaaatagagaactggcctcgttggcctcagcggtggagctctcggcag

SEQ ID NO: 400542 - DNA, 339 bp, Homo sapiens
gctggagacggcggcagtggcatgctgaacccagaccagggctggccccaaggctggagtgcgcagagtgtggcctggaagaatgaaaaagagtttcgcaggctggagggaaacactgtggaggaggggcttccctcactggggtagcagtttccggcttgccccacatggcaggatttccatagtatatgtagtatgagttctacatcttggcctgttacccggctttggcagtctcatctccaccacctggagaataaatgggatctgcacgaactccactctaaactgaaatacatggccgggcagtgactcacacctgtaatcccagcactttgg

SEQ ID NO: 400543 - DNA, 425 bp, Homo sapiens
aaaatatgtagccccagccctgaagcatgccccaccccactgaccccttcatttccctccgtaccacttatcaccatgtcacaaatatctgcttgcttgttgtctttatcctcccacagaatataataatgacagggccgggcacggtggctcatgcctgtaatcccagcactttgggaggctgaggtgggcagatcacctgaggttgggggtttgagaccagcctgaccaacacggagaaaccccatctctactaaaaatacaaaattagctgggtgtggcggcccatgcctgtaatcccagctactcaggaggctgaggcagaagaatcactggaacccaggaggcggaggttgtgatgagtcgagatcgcatcatagcactttccagcctgggtaacaagagcaaaacttcatctcaaaaaa

SEQ ID NO: 400544 - DNA, 413 bp, Homo sapiens
ctcctaaactctgtgcagacaaatttatttggctttggaatttataattctagcttcagttttgcctgctttgtgaaaatgccataatcccattagtttttctttaattgctcttattctttatagtagagaagtatgcaaaacaactctacacatttaagtgcacacaagaattatgtggattatcagaatgcaattacatttcaagattgtagtgagctaattttcaatttggaccttattcttttttctcctcttcctttttatttttgcctaaacaccactacttgaaatgataactcattgaaacttttataaatgaagtagctctcaatttgttctttagcactgccactttccgccaaggctttttcacttgttaaatcatgacttattaaactgatgtaatgtta

SEQ ID NO: 400545 - DNA, 480 bp, Homo sapiens
tttttgtaattttttaaatcttagcagctatcattagtgtttgtgtattttatgtgtactccaaggcaactccttctttcaacgtggcccagggaggccaaaagattggacacccctgcaaactaatcacatcaatctctcttgattacactgtgtgatggtcatattagtctctctacatgggaagatgttgtgcttactatggccagtcactttgacaaagaaaagccaaattcttttctaaagaattgttccttattaccaaactcccagtaaccccctcaaagaataattgccccttgcttaatcatgcaattgcatattatgtttatactcacttcagcacttatcagagataattgcagtttcacaaggtttactttttaaagtataaacaaattatgtatttacttactaatagaaaatataggtaatttgggaaaatttatgtacattgttaaataaaattatatctatcta

SEQ ID NO: 400546 - DNA, 386 bp, Homo sapiens
agaggttcttacacttcctttcaacacccccaaaggactgtccttcgcttcctgctttggataccaatataatctcaacctcgttttctgtcctacacaattggtctcagccttattttctgttccacacaactgacaaatgcagtaaactccaggcagcaggggctggagctcaacacagaagagtggctttaactggactcagggccactcaacaggcaagtagctctcaatctggtttgtacactgcaaccaccagggagctttcaaaaaggaccaataacgagtccccctaccagagatttgatggaattgatatagagtttgacctgggtgtcaggtttttttaaaagttccacaggtgttcctaatgtatagccaacacc

SEQ ID NO: 400547 - DNA, 289 bp, Homo sapiens
gtagatgggctcatgctacattgccccagctggtctcaaactcctggcattaagcaatcatcctgcctcagcttcccacagtgctgggattactttacccttagtaatttaatttccagtgaaaactataaagcaaacaattgtgaactgtcacaccagcattctgtacattgacatatctatgaactgtaattactagaagcatgtgccttctcatggtataatttttcaatgtgacagaaaacacatttggtaatggacctaactatctttagtctctctgtaataa

SEQ ID NO: 400548 - DNA, 307 bp, Homo sapiens
cagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattataaatgaagattgcttggtagtggactaatggataattgtttctgcttctttaggattttctaaatttttcccaagttttgtatattaagcacaaaattataacaggaaaataaagaaaagaatttaaaataaacatgcaaccaaa

SEQ ID NO: 400549 - DNA, 416 bp, Homo sapiens
aaaattcaagaggtatttcccaaaagaaatgttagaagatgccttaagaacagaaacagaatctggaaaagttaagactgtaagctcaatgaggacaggtacttctgtgtgttttgttcactggcatattccatgcaccttgaagaatacctaacacatggtatgcactcaacaaatactcgtcaaatggtaagggaaaaggaagggccattattttaaaagtagataaatcctgaaatgtggaggaatagaattgagacacatcaaagatgattgtatcatatctgtcagtaaagtaagaagctagtgggtgtggaggaggatggccctccacatgcatgaccacctctggggaaatcattaggaatcaataagaaagtaacaaaaataagtactgtttttctgccgagatttcc

SEQ ID NO: 400550 - DNA, 416 bp, Homo sapiens
tatgtgtgagatggagcctgcttgcttgattgattgggagacagcatacttagggtttggcatgcaggctctgcagccagattatctgtccctggacaggttctgactgcaacatttactcactttgtgactttggggaatctagttggtttttctatgcatctttttcctcatttataaaatgtagatgatactaataatacctaccatcaatggttgttatgacggcttaaaatagctaaaccttacctgtaaggcacataaaactgtgtctagcatataataaatattctattttgtggaataattaaccaattgaaacctttaaaagtggtccaaattctctaaataatgtaatttacatttgactttgtatgatggaagtttcatactctgtagcaatctaaaagcaaaaa

SEQ ID NO: 400551 - DNA, 283 bp, Homo sapiens
aatggccacattgtatttgtttttttaaatgacatctggtcatcatcgaaatcaagcaaaacaaaattaagagaacctacccaagatgtcagtgaaattggaacattcctgacaataccagggcataaatgcaggaatcaggaataggcagcagtgatagaacaattctgtttgtgcccttgttaacgtgaagttcaaagtcatctttgcaattagccaaaagaatctgaagtgaagctgaggaaattgctgatgttgaaataaacatttccttccatgagga

SEQ ID NO: 400552 - DNA, 420 bp, Homo sapiens
ctcaaaagcattatgctaagtgaaagaagtcagacacaaagtattacatactgtgtgacttcatgtatgtaaaattctagaaaaagcaagagtagaggaacagaatacagatcagtggtttccagaggctaggatgggagagagattgactacaaagagcccaaaaggaatttttttcaggggataggataatagtctatatctttatggtagtagttataggactatatacatgtacgtgtttcaaattttatttaactgtgcactgaaaaagagtagactttactgtatgtagttgtactcaataaacctctcttaaaatatacttggggcagcgggaggagggaattattctccctgcttcagtttcctcatctgtaatgtagacccgataataaaacactgcaagctccgcctccc

SEQ ID NO: 400553 - DNA, 984 bp, Homo sapiens
tctgagcatacttaattttcctctcctgctttatgttatttttgtcataagctctctctctcttttaacctgagacatgagttttcttgttcggtggaatcaatgtctattagatttactcacatttttaccactgacatctcagatttcccgtctggggccattttccttcctcatgcaaggcatcctttagaatttcctttaacgaagacgttctagtggcacactttttgtctggcttttcttttgcctctcgtcttgaatgtaactttcatttggttcacatgggagtctagactggcggttaggtctctcccgacacacggagatgccatctcaccttctgccgctcccactgggaaatctgcaggtcccagggtttgccatcgtctgtcctcgttcctggccacttccaagatgactccgtgctttgtgttctgcaggctcactagacacttaaaacaaaatcatattgggcttccttgggcttcttaaatctgtggcttgtatcttcttcagatctggaaaattcttagcctttgttgcttcaagctgttgcctctgtcccacgtgttctcttttctcttcaaattctgacagtgacatcctgcgccacatcctctcttaggcaagtcacttccctggacccgctttccaggggatgcaaaacgcagggccccccttgcagacctgactcctcagtgagctgaaggcagggcctgactagaatgtgtgtgtatcaagagccaaagtcaaaacagtagagccagccgtgcttagcatccagctcctctgcaaagaaggaaatgtgtgtgccctagtgggtgggaaatacgaattgtgtgcttttggtgattccacgtatgacttaaatgctctaatatttgcacttaaaactgacattctggtgtaaagatgcactgtgaaagtcataaaatttataatttaattttttcttagaataacattaaataaacagcaaat

SEQ ID NO: 400554 - DNA, 343 bp, Homo sapiens
  misc_feature (228)..(228): n is a, c, g, or t
tgagaacaagcagctgtgtgcgtgagcccaggctgagggagctggacttcaccttccactctagacagattcctggaatgtgagcagacggaccgtttacaaatggccctacttctctcattcaactaacgttactgatcattttcaatggattccattcagtggaatctgaatctactctgcatctactctgtgtttggaggctggatgggatatgatcactggccntttctttctgctgagtggttcactgtgtaaacaaatggcttgcagtctccagggcaccacagaccccagtgatgcacctgttttaagtcaaacactctttttggtatattaacaa

SEQ ID NO: 400555 - DNA, 147 bp, Homo sapiens
atggagttgtcctgggtaaaacatcccccttccctggaagaggacaggcaaagcttggcttgatcctggaccagtgtcttcttgctaacacgtatgcaacattaaaaccatcagggtttgccatatcgactttgggagctttatctg

SEQ ID NO: 400556 - DNA, 336 bp, Homo sapiens
aaagggagccaccgaggcaggaagaagtgaaagtccctttctcagcgatctaccttccaggaagcaacaacccagcaggtctcaacaaagccccgaggctgtgatacagctacccctggggcaggtccaacgcgctgttatcatactctccgagcttcatccaaatgctcacacacccaacctagtgcttcctcgcgataacaccagtagcaggagcagcccagtgtcatcctgcacaaacaggtggtgtttacgcacggcatgtcaccgagagccatctgaccagccgtgccaaccgggagcaaagggggctgataaaggcagcttatcacaaac

SEQ ID NO: 400557 - DNA, 150 bp, Homo sapiens
agatgattataggtgtaattggcacatggaattagattggaaagtggcttacaaagtaggtactgaagtggaaaacctgagagaattttaaaaatacatgttgtgtatgcggtatgtacatgtgtggatatttacgtccgtacatcctgt

SEQ ID NO: 400558 - DNA, 405 bp, Homo sapiens
ggaatattggctggttagttgtattattgtctgtatagcaatttctctttctcaaacaagtataagtactaccaattttgaaacacattttgatggaaagcttaatgtagacatagtgcatggccacttactgctaaagatggaattttaattagggcctctctaatgttctttttactgctaacattttatcacatgtgacacactcaaatttaagccaaagtcatgctaggctagcattttaatgtgtataaaacgtcacatcctgtctccaactcactaaatataataatcaaggctagtttcctggtgatattttaaaggacaagaaaaggatacaagaattaaaaattgccttttaagacaattttgtccttatttctacacagtatgtttattatagaa

SEQ ID NO: 400559 - DNA, 952 bp, Homo sapiens
taaaaagataaggttttccaaagacttccaactgttccagtcctctttttgatttttttctataatgtaaacaactaattcagagtctgtgaaaatttgccttgaaacccattaaaatgaatttattgtttccaaaaatattaattagacaagctctgaatatgaacaataccattgaatagcttctaaaagaatgagtatttccagatgttttaaattaccttttgtctttgaagctttccttattttccttgcgatatcctattttctcttttgtgacaaaaaaattagacaaacatgttgaaaattggttataattcctaccatcacatgctatttcagatagtgactaataaacacattacatcactgtaatgtctttcccatgtagtcctgactgttcttgatagaacagattcaccatccagatcttatctatgcattgatccctcaataaaggaataacccaagatgaagttggcagtgggtatacacacagctatgtcacaccaaacttgaaatactttttagaagttttaaatgctgataaacaaactcttaggacaaatcactaatgagcatggaattcccatcttcttcagatttattcatcataaatggttttcacagattttatcataaaaacataatcttctctttcattcatagtttataattcacatgatttattcacattaaccagctgtgattggagaatcaggaggagctttgagtcccatattttataaatgcttctgagaagtaccatagttaatgcccctttcaaataaataattttggatggttgtggtggctcatacttgtaatcccagcactttgagaggccaaggcaggaggatcccatgagcccaggagggcaaggctgcagtgagccatgatcagagcactgcattccagcctgggcgacagagcaagagcctgtctcaaaaaa

SEQ ID NO: 400560 - DNA, 472 bp, Homo sapiens
ctgtgtggtggaattgtgattttcattttttaacttacatttttataagtattttcaaggataattaaaatgaacatgcatttccttataattagaaaagttagaaatagttataaaactattttcataaagctgttgtacttaggtctgaggacgtttgaggatactaacattgatgaaaaaagaacccttctctccctccttgcactctctccccactctttttatcttctaggattgaacagttgcatttgaatgtagggtaagtttattagaggagaatatagaaattatggtatattagtatattgcattaagtgtatatcttactttttagttaatttttaaagtttattcataggatttgcctagggtataatttatggagcttataaataaatatccatttaggagacagtgttaatagatccattacagtgagcatttattaatcatcttttgtataaaaggt

SEQ ID NO: 400561 - DNA, 563 bp, Homo sapiens
aaaccctgaaagttttggaatatgagaaacgggaccgagaaatgtgtgagtcccatttttcagccttttcctccttttgctcagcagacactgaatataatccacaggcagtacagacttattcttccaaaggatttattatgtaatcttgtacaagcctcaacttttctcatttataaaatgggaaaaatatcttccttacccaattgttgagtgaactgtgaaacatccatatgtattattgtgtatcagtacatatatgctatttttgtagtaggcctccagaaaatggaggctatatactgtttcatttcttaaaaggatactttcacttggttcaaagttcaaaagatagttatatattgtatttcttgaaatcttttcacttctgttcccagccacacaatttccctccatgatccatgtttcttttgcatcttgccagatattttatgtacgtctaaaagtaaaaacgtattttccccactttaacaattttacataaaatcacactattgcttgttttgccttttaaaataaaaatacatttttgaaattgttca

SEQ ID NO: 400562 - DNA, 498 bp, Homo sapiens
ctaaggctggacttcaggagactgtggccttaccgggaaagtaaagacgggttgacagtggcagagtgtggtgagaaggggctaaaggacaggtgcccaggagtggagaagccctggagactctggagaggatggggctccagttcaaaaaggagggaggttgaagcaaggtagacctgaataaaactcattcctgtttaaaataattttgtatacattccaagatgattttatatatatatatttattatactttaagttctagggtacatgtgcacgttctgtacatgtatcccggaactcaaagtataataataataagtagacagaatattggaatgctcctatattactgataggaatgtaaaatggtacagccattttggaaaacagtttgacagtttctcaaaatgctaaatacagagttaccatgtgacccaggaatttcactcctaagtatatgcccaagagaactaaggacgtattcatgcaaaaaaa

SEQ ID NO: 400563 - DNA, 355 bp, Homo sapiens
atatttaaaaatggtcttggacagtttgtattaattactcagaatttgaatatgctcattgtttatcatcattataataacagtcctacctcaggtttatatgtttattcccatatatttgggttcctttaattatcttatgtatttttatgatgtctgcaaaataaaaggggaatgagtgttattataccaatttttatggatgcgggaacctgagcatagcctctctaaataagttgctaaagtcatttttctgatacaatccacaaccagattgactgcttacctagactcttagctttgtctggagctgtatcaagctagttagaagtgcaaagtctaaatttattgactg

SEQ ID NO: 400564 - DNA, 108 bp, Homo sapiens
ctcttacataaaggtgagctggatgtctactatattccaggcacttggctagtcactctatagtttttaatgacattctgtttaatcttgagagcattatttttctat

SEQ ID NO: 400565 - DNA, 293 bp, Homo sapiens
tattggggtacagcagtatttggttacatgagtaagttctttagtggtgtgtatgtcttcttttgagaaatgtctgtccagatcatctgcccattttttaataggaatgtttttttcctgttgagatgtttgagttccttgtatgttctgggtatcaatcccttgtcaggtgaacagtttgcaaatgtttcccccaattctgtgtgttgtcttttcactctgttgattgtttcttttgctgcacaaaagttacagtgttgtccttccactcaccgccatgtcctatcaggtgc

SEQ ID NO: 400566 - DNA, 457 bp, Homo sapiens
cagcaaggtcataaatctcttcatcaccctccatggaccatgagaccagccaactaggagtcacctgaaatcaccagccaaatgtcagctgaaattctgaaacagaataatcctaagctcaatgctatttacccaggaaaaatgatttcttttgttctaaattttcaatccaagacgtttaggggatcagaaaaatcacaattctatttatttatatacttatttatttatttatttagagacagagtcttgctctgtcacccaggccggagtgcagtggcgccatctcggctcactgcaagctccgcctcccgggttcacgccattctcctgtaatcccagctactccagaggctgaggcagaagaatcgcttgaacctgggaggcagaggttgcattgagctgagattgccactgcatttcatcctgggtgacagcaagactccgtctcaaaaaa

SEQ ID NO: 400567 - DNA, 514 bp, Homo sapiens
tttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcag

SEQ ID NO: 400568 - DNA, 429 bp, Homo sapiens
cactcaaatgattacactttggaggcattttcttatattaaaaaatattttaatgcataacttccatgaaaagttgcatattttccaatacggggttccctgactgctcacccaccatcttgcctttcagcaggtttcgtacttttaggtttcattgttctattcagggcttccagagttctccattgatttcagatccccaaggccaggccaagccatgcctctcactgcattcccatgacctaaagcacagggacctgcactctttctaccgatctctgaaatgtttcatatttacaagatatggcccagagactgattctaattcattctctccccaccaaagaaagaggtaaaattatattgattgtttatatctttttcactctacaaataatctgtttactataaaaaatacagaccagcaaa

SEQ ID NO: 400569 - DNA, 523 bp, Homo sapiens
tctcctagatacagaccaaggttgaacaagcactcccaggggaataaagccactagttgagccatgccaatcaaatcctctcttttggaaacttgaacaaagacatagagattacaatgagaatttgaaggaggctgtataagatactagactgacagccgtgcatggtcatgagcagcccagggatgaccactgggagaagagaaagcggagagcagcagagatcacagaaatcatgaggccctgaaaagtgaagatcccgccctcactttctcactttcctgatgcagtcatgtgaaatttgtctttacttccatttacttcctttccaactctcagtgttctgaaatgtaccattacgtaaaagtgacagaaaatgaagaaaaaccattaattcctagtgggatttcccatttttactctcactccccattaccaccaaataaaactgtttttgttgagcaaacttttctataagcctctttgcattcttactttgcatcccaggaggtacaagtaagaa

SEQ ID NO: 400570 - DNA, 356 bp, Homo sapiens
cccaccttggcctcccaaagtgctgggattacaggcgtgagacaccaggcccagcctcaactgtagacttttaactcaaaggtacaaaaattggattatgtctgggccagttttttcccttgtcgatagtatagcccattggttagagttcagactgaggctacaagtagaactggattctttcttttttttttttttaagctgtataagtgaaaactacttgggcaagttacttaacctcttggtatattagtttcctcatctgtaaaattctggttatgcttgccttttagtgtttgttaaacattcttatgatcaaaaaacaagcaaataaaaactccttatcttcatccaca

SEQ ID NO: 400571 - DNA, 351 bp, Homo sapiens
gtaaaaagggagaaagaaaaagaagggaaagcagtgggactgaagaagctcacgccctgcttcatgcaggtaaatctggatttctgggggtaggacccaacctgcagcccagtttaagagccaatgccctgaccactttttgtaaatatgtataaggaagtgtcatggtggtgtcacaaacactttatttttcatttgaagaaaatgccattgatttctaaacaaggtcttccaaagaaaatgtttgcttatttgagttgataccaacttgaggttggtgtttttctattatctactccaatatcaaccactctgtaaatggaaataaatacataatgcatgtcacatagt

SEQ ID NO: 400572 - DNA, 861 bp, Homo sapiens
cagggacagtgagttctggaacgggtcaccagggctgcccatgttcagctctaaattctatagatctagaaagtgcttttcatttctgtgaggtgcccctctcagacactgggacgttactcagtgctaaaaagaaatgagccttcaagccatgaaaagacaaggaggaaatttaaacgcatgttactaagtgaaagaagccaatctgaaaaggctgcatattccaacttatgacattctagaaaaggcagagctatggagacaggaaaaagagcagtggctgccaggggttcgggatgagggagggtgaatagttggagcacagaggattcttaggacagtgaaagtcccctgtctggcaatgtagccagggatggatggcatggtacatgtgtcagacccatagaacgtgcaaccccagagtgagctgtaatggaaacgatagactccgggtgatggtgatgggtctgtgcaggttcacggactgtaacaaatgcaccactctgggccgggcccggtggctcacgcctgtaatcccaacactttgggaggccgagttgggcagatcacctgaggacaggagtccgagaccagcttggctaacgtggcaaaaccccgtcgctactaaaaataaaaaattaaaaattaaaaaattaaaaaaaattagccggtcgtgatagcaggcgcctgtaatcccagctactccggagactgaggcaggagaatcgcttgaacccgagaggtggaggttgcagtgagctgagatcacccactgcactccagcctgggcctcagagcaagagtccatctcaaaaaaacaacaaaacacaaaagacaaatgcaccactctggcgataacag

SEQ ID NO: 400573 - DNA, 470 bp, Homo sapiens
ccctttcctgattgattctttctgaataatgccttttaaccaatcaaatgttgcctttccattactacctatggcctgcccctcccctattctaagcccataaaagcccaagactcagccacattgggggtactttcctgccttttagagggaccacccccatgttccctctccctggaaagctgttttgtcactgaataaaactctccactttgcccactctttgactgtcagtgtatcttcattcttcttggacactggacaagaactcaggaactagtgcacaaaccggagtcagcccgggtaggatgatttgacagagcacctcctacagcaggtagcatgcctctagcattgctgactggaggtccctgactggcaaagggacaaagaaatatcctgtatcactgtcaattaacaagaaagattttgttacaatagtatgataaaaataaagtctcaatggctta

SEQ ID NO: 400574 - DNA, 685 bp, Homo sapiens
taaagcattaataatgatctggtcttaacatatcacagtgactacatgtcttactcttgatactgatggagagacctatcgtcatcaccttatccatgcaagtgttccctaggcctgtaatctttgaggggtggctgtgttgcccagatgtgttattcaagtgcaaaccagaactgattgtgacattcaagtgcaaaccagaactgcagagggtaatgcaggagagtccactcctttttgcttacatttgaatttcagtccacactgactctacttgaggtgtaaattggagaattccttctccacagcctttgttttcttctctttcccccgcaaactacttctcgtttctcctccctttttcttgtttgaaaacctctgccttcttcacactcacttccccaggatctgctttttccttctttcagcctcttgttctcccagtcaagcaaacaggaagtgggaggtgagggagcctcagatcctgtgcaggatatggggtgggagaggtattacagaaagggcttctttcagagtagacttctgatgaagcggcaccttacagacaagcctttctatggtaaacatgtggtgtgttattgtgaacaaggaatatctgtctcatttctcggccttacaaaaatcttgttcaactatcttagtctggtaagagttgaggtactag

SEQ ID NO: 400575 - DNA, 613 bp, Homo sapiens
aatccaaagtattttattctaatgtgatagggaaatgagacctaatgtctcctgattcagtttaaggagagatagatcaacattatgtttcatatgatggctttaatgtatattctgattaggcattttaaagtaacctgttaactcctttttaaagttaataatatcttattgtataatatacatatgtcagacagtatttacaaaacttcttagttgctcagatactataaggaaacaagataagtagagggttgctcagccttagattgataaaaatctacttttagagatgatgtgacattaatccaaccagtctgtgatcagtacatggctgcattcttttgacttcacccccaagctgttatgtctcttcatatataatcttgccctgtgatttgagaaagggtaggttagttatgtgttctgagatcatgtaatgtatattaataaaaatacaaaaattagccgagtgtggtggtgcatgcctgtaatcccagctactcgggaggctgaggcgggagattggcttgaatccgggaggtggaggttgctgtgagctgagattgtgccactgcactccagcctggtgacaaagcgagactctgtctca

SEQ ID NO: 400576 - DNA, 911 bp, Homo sapiens
cttcgtggtggtttgacttattattatgtaatctccctggcaatattctttgctctgaagttgattttatcttatattaatacagccactcctgctttcttcagcctccgcctgatctgtctgcttccattactgatcctgctttgtacccctttgctggaataaactgcagctgtaagactctgagttatgtgagtccttctagtgaattatcagatgtgtagagggtcatgagaccccccaaaacaaagagccaaaactgattacagtgacgagattagacaacactgaaggacagaaaccccacccagtgtctgtcccaggcccaagccctgcggcccgctgcaaccttgaagaaaccatctacacatcttcgcccacaccccctcctcccagcctctcctcagagcagcaccctgggctttatgtgctgggattctgtgtaatatttttggttgataacaggttcaatgtttgaaaagaagaacacgaaagtcatcagtgaaatctaatgacctcatgttacaagtgagagaattcattctcagacccgccctgactggctcaggatgacagctgtcagaggaggcatcactcaatgaacacatggtcccaggcctctggccccctgcccagtgtccggtttcccagtagactaagctcaccccaaagatgacacatccgagagacaacacagctagggtaacaaacagcagatgtgacttaactactcaggggagtgggaggaggcactacttctggggaagggcaccgtcacaaacactgtgctgtaaaagacttaagctcagaagaggaagcactctggatgtccagtcacacagctcagttcaagacagactctgctgcccgtgcctgatacagtctccagccttgttcgacaagcagagaag

SEQ ID NO: 400577 - DNA, 443 bp, Homo sapiens
caggtactcaacagctccccagaccagaaacaaacatgctacaatcagggagtttggcaaatccagccagagcctctgagcccaggtgccaggcccgcctgggaccccagccttctggggaaggggtagtttcaggctgaagcaccccctctctgctctcctgctcagcgtctgggttagaggcactgcctgaccctaacaggccccgcccctagttgggggagtcagctgctgcctttaggggttgggggacagaagacagggaccaattaacaaagggagcgatttggggggctattacccccattctaggttgccagataaaatacagaataatatgccagttaaattggaattacaaataaacaaatactttttgggtataagtatgttccaacttctgcttgagacattattttaaaattgtttatctgaaattcaaa

SEQ ID NO: 400578 - DNA, 177 bp, Homo sapiens
ctcctccctgcaaagccgcagaccaaaaggaaaatgactaccaaaaaaatactgtttttcgtggtttctgttcccttccctttcacccacctcccttccctctctctactttgccttctctttgttggctacagggataaacccagaaagctgacaggtagctacctaaacttgaga

SEQ ID NO: 400579 - DNA, 526 bp, Homo sapiens
tgtgtgtcaactaggtgtgttctaaacatcatttttccagttggaggaatgctgagtttggagatggctgataaatgtgtcatctggataacattctgagattgatataggaatgccttcttttgcttctttagctgccttgaccaatgtagtgatgctgacagaggctataaaaaatgtggctctccaatcttgggcactttatgtaaccttgctcctgggaggccgagcacatattcagcaggaaggaacttgctggctcagttaccatgattcatgccaacaaatcaaagaatgctgctaatgaatcacaaaaggtggagaatgctaaacagcaatgcttctgtcactctgttgtggctattaatcaagatgatgcattgctaagacagctgcctgggtatgacaggaagcaaattgctgtgtctgcctgtcagaagtttatttgctactttgagtatatggaacatgaatgtcaactgaatgtatttaaagaaagtgcaaattaaacatgaagatcttcaaa

SEQ ID NO: 400580 - DNA, 1279 bp, Homo sapiens
tcttattttaccaaaagatggtgcaaatctatgaccttcacattttttccaccacacccaccagtagctgttggtgattgcatggtgtctcggtgcatggggaaaggcaaggtcttctgagctcatcttaactggtgaggcatctggatgtgtctgatcttactgtgatgttttactgtaccgagcccaatgtgggtccatctcatcagccctttgctgatttcatgatttctcaccctccctcccatatgtagggtgtgattctgttttattatagccacatgttttattaacagaatgagtgatatgaagcttgtacttatgcatttctcgggcctcttccctcattttcatcagtctgtctaagaacttgactcggcactgtttctcgtgtaatatccttctaatgcttagcaacaacaacaaaaaattgctctctcagatccataatccatactcagtgaaagcagggaaaaaatattttcacttattttatttgcttctaaaatgcaaagatgaatactaaagtcagaagcagtgtttcattttgaacacattttggattattaagctgactaagcaatgatctaatacacatttcatattttctttataataatttcttatggagaagaggctatatttcaaaggaattgagacatactcccatctataaacatgtttggttttcttacgatacagggccatttttttaaaactctcaggactgaacagaagagaaaaattattaattagctgctactgtatgttgattcttttcggagaaattgaaataagctctttgcaggcgtccaatcctagaaaccaatggtctccagaactctcacacaagtgtttttctgattctatgataactaattaaccatcatctggtgattaaaagaacataaagtaagattatgattaagtgtccatcacctgcctgtcagccgtggtcagaataagttttacacgaagcaggtgaaagatttagttcttttcaaagtaacttattttcttgtgacccgtttatgatgttgtttgaagtccctgtttcccattgtgtacgcactttctggatgtctggaaggatcgggacttttgtgtgagaggcttgagcgcctcctctatgtgggctggtgtccttcttgaagttgtcaattcctcttattcttaaatatctaaagggaaaggaaaccaactttaatttcagaacttctctttacgtcttgtatgtatttcttttctgttctcaaggaggaaaattggtctaggaagc

SEQ ID NO: 400581 - DNA, 441 bp, Homo sapiens
gagagctccctagtgtctgctggaatgtgatggctgtaagacgcagggaggagaaatggaaaaggagcgtctttattgacccaacagagccttgtaaaaaagcaccaactacatatatgcagtctgtgcatttcaaaagtaacaaacaaacaaaatcagtttaccaactcttgggagagaaaatggattatcattcactgcaaattctcctaggtaaacagaagagtgctacacctgtgcagagagaaaagttttatatatgctcaactatgggtcctcagtataatacagtcccatcatgtatttcctgagacatctactaaggagacttcctagaattgaatctttctcatctttttttctcttttcttcctcaagtcttctgtgacatgtgataatacaaaacaaaatacaggtcttagaataaatgtacctggaatc

SEQ ID NO: 400582 - DNA, 836 bp, Homo sapiens
gagagctccctagtgtctgctggaatgtgatggctgtaagacgcagggaggagaaatggaaaaggagcgtctttattgacccaacagagccttgtaaaaaagcaccaactacatatatgcagtctgtgcatttcaaaagtaacaaacaaacaaaatcagtttaccaactcttgggagagaaaatggattatcattcactgcaaattctcctaggtaaacagaagagtgctacacctgtgcagagagaaaagttttatatatgctcaactatgggtcctcagtataatacagtcccatcatgtatttcctgagacatctactaaggagacttcctagaattgaatctttctcatctttttttctcttttcttcctcaagtcttctgtgacatgtgataatacaaaacaaaatacaggtcttagaataaatgtacctggaatcaagtcattgtgaaatgttgggcttctttgaccctcagtattcccatcgcaaaccaggaataataagacctgcatttctccattgaccattagtaaattgagcttcaattacctagttagagaaaaagttaaatattgcctccaaagcttaacatgcattttaatatttttgctttctgcttttaaaaatatgcttctcattttcttcccctgactagctctttgactgccagagagatgtataagcatcttgagctccactggtagagttatgagttcttgaatttagaggttattagaagaattttttcctactgttttcatgtaaattaccactcaggaaaaaatggtggaatagaatcttttttcccttttatagtgtctttttcattgctt

SEQ ID NO: 400583 - DNA, 448 bp, Homo sapiens
attctgtgcgtcgactgagatcaggttagatgagtccttagggtgtttctttcccaactatgcaatatacaattggatagggatttttcatataaatataccccatcttttgttttccaagccagagtaactgctctaaccatggacatcatgcccagtcagaacgaagtctgggcttggcactgtggctcacgtctataatcccagcactttgggaggccaaggtcggaagatcacttgagcccaggagttcaagactagactgggcaacatagtgagactccatcactacaaaaatttaaaaatcagctgagtgtcgtggcatatacctgtagttccatctactcaggaggctaaagtgggaggatcccttgagcccaggaggtcgaggctgcagagagctgtaattgcaccactgcactctagcctttgagaccctgtcttgaag

SEQ ID NO: 400584 - DNA, 447 bp, Homo sapiens
tgagagaggagagcgaggtggggaccatttgtgaaggttactgtatgtcatgtggagagctttggaatttatcccatcatcggcatggttctgcaccccgtcgtgtgaagaaatcatccggagaacttgttctgagtccagaagttacctacaggctgccttgaggcagtggtcctcacacggcatcctcctggctcccttccaactgcagctgccgtgaacatgggacagtccccgcatgtggacagtgccctgcctcaggtgctcgtggggtgctctgccgtgggagcacactcagctcgtgcatgtgttggggcatcagtgccctgagggcagccttcaacaagcagtggataaatgtcccagtcttggagagacatttgcgacatgcatttaagcagaagactcccatgatctgatttcagttaaaaaaaaaaaaactcactg

SEQ ID NO: 400585 - DNA, 508 bp, Homo sapiens
acagagtagacactcctatcactgttgttagacagtggtcatgggagagggtcttgtgtgcctcggataccagggccctctttttattgggaggtgcttgttatttctgtgtgtggctgcatttgtttcccaagactgccacaacaaattcatcaccaacttggtagctcaacatagcacagctttattcccttcctgggattgggctatcattgatagcccaatcccaggaccccagcactctcctggttcgtggtctttcccactctctcctaggatagatattttaaaagattctgctcttattcctcagctctttcacccttctgttctctctagctcagcaaaagcagtcatacctggggcttcgtgctatctcccccaactcagaaaagaattcccagcactctctcttctgccctgactctgtctctccaactcaatttacatttttcaattgccttctggccattctctctctcttctttttgagatggggtctcactct

SEQ ID NO: 400586 - DNA, 333 bp, Homo sapiens
aatggtgctacagcaatttatcagtgttcttgaaattccattctgtggatcccaggaccccagcactctcctggttcgtggtctttcccactctctcctaggatagatattttaaaagattctgctcttattcctcagctctttcacccttctgttctctctagctcagcaaaagcagtcatacctggggcttcgtgctatctcccccaactcagaaaagaattcccagcactctctcttctgccctgactctgtctctccaactcaatttacatttttcaattgccttctggccattctctctctcttctttttgagatggggtctcactct

SEQ ID NO: 400587 - DNA, 639 bp, Homo sapiens
aaaagacacaagatcctgatccatagctgttataaatataggaagcagggggttcagacagatgtaaggaagggattatggaccaggtggaaagtatctttgccttggatttcctcaaatgaatgtatctatagggaaccttgtacttgtactgctgtccagaaacccaacggaatggcaggttgtctcctgttacagacacagggaataatgggttttctcctcttgcagatgtaaggatgacttatcaagaaactttcacacagcacaggtatgcacaacagagttgaagagcttgaaatgcagagagtacatcttggatctgagagtacccttgagctccgtgttcagcaagaaagcagtgagcgccatgggctctgtggtactggcatcaggttactcacctgtcttggagcttatcaacgatctactttacatctcatatttgataccagaaactgctaaaaataaaatcagatcaagtaaaacaggaataaaggggtttattgtgcctacggcatcaggttactcacctgccttggagcttatcaaggatctagtttacatctcatatttgacaccagaaactgttaaaaataaaataaataaataaataaataaataaaaataaaaaatgag

SEQ ID NO: 400588 - DNA, 560 bp, Homo sapiens
gtcaagctcgctgacttcaagaatgaagctgcgggcctcacagtgagtgttacagctcttttcaggaatgaagccgcagacactcgcagtttgaggatacatgtgaaattcctgtcatgggattttgttgtacagattatttcatcactcagatgtaaggatgacttatcaagaaactttcacacagcacaggtatgcacaacagagttgaagagcttgaaatgcagagagtacatcttggatctgagagtacccttgagctccgtgttcagcaagaaagcagtgagcgccatgggctctgtggtactggcatcaggttactcacctgtcttggagcttatcaacgatctactttacatctcatatttgataccagaaactgctaaaaataaaatcagatcaagtaaaacaggaataaaggggtttattgtgcctacggcatcaggttactcacctgccttggagcttatcaaggatctagtttacatctcatatttgacaccagaaactgttaaaaataaaataaataaataaataaataaataaaaataaaaaatgag

SEQ ID NO: 400589 - DNA, 427 bp, Homo sapiens
gagttctgagcttatgaaactcaagactgcctggagtagaatccctccatgagtgtcagaggtgcagtgccaatgtgcttgttcccgagcttagctctggtggtatgggcctgtccgccttccctctctccctgaccttccctccctcgcccacacacccacttccttccactgtgaaagcggagtaaggctttaattgcacaggttcatcatttcttgtttggaagtcttcagatttttagttttataccttagctttctgcagaattctccgttgaatcaatgccctgggaaccccatggacagaagcaccttttaatgaagtccttccaaaactcgttcctcagtgcattgctctgttggaaacagtgctgtggggtgttggggtgtatagtatattttaacatattttaacttaaaaaaaaaa

SEQ ID NO: 400590 - DNA, 343 bp, Homo sapiens
cccattgtatagcgacttcgaaaatatgggaacacagttagttattttgagacttccctccctcgcccacacacccacttccttccactgtgaaagcggagtaaggctttaattgcacaggttcatcatttcttgtttggaagtcttcagatttttagttttataccttagctttctgcagaattctccgttgaatcaatgccctgggaaccccatggacagaagcaccttttaatgaagtccttccaaaactcgttcctcagtgcattgctctgttggaaacagtgctgtggggtgttggggtgtatagtatattttaacatattttaacttaaaaaaaaaa

SEQ ID NO: 400591 - DNA, 599 bp, Homo sapiens
tggcttagaggctgcatctgtccatatccttctcactgcaagtgtcagaaatcctggctcaatctaacttagatgaggaggacatttattatctcacttaaagggaagactagaggtgatgcaggccccaaggtggttaatacagtggcttaactctgccaccaacagtaccatgccttcatggtgggttttatcctcaaactggtagtaagatggttacagaagctccatgtcatatccagagaacactcagcgggaggagagacagagactagatcttcttgtgtctctgaggagtgaagaaatttttcttggaagccctctggctgaattcactatgttgtagagaattggtcacaactgtattcctaaatccatcactggcaagggggtataggagtctcatgagtagatgagactgagcaggagatccccctggagctgaaggtgggagagaaaggtggatacaaaagtgatcaaaaagtaggaccaaatgacagaatgggaaaagatgcttgcagtgtctaaaactgactaatatctagaatacacaaggaattcctacaaatcaggaaaaagacagcaaccccatagaaaaa

SEQ ID NO: 400592 - DNA, 592 bp, Homo sapiens
cctgcacctaatctgtgagaagagttaatggcctacatcataaggggaaaagatataaatgaaatttctaactctcacctctggtgttctggactacatacgctcaggaaactgcttagaaaatgagctaagaatagtcatgcagcaaatagaagagctcagaataagctcataataaaatttgtgtttgctttgttttatagattgagaaagaagaccgtaagctcttttagaagcactagttcagcagaaggattttactgtcctacatttgtggttttcaggcctctccccttttcctgagtgatgaaagcctcttcataggaagttgtgtgatacagagtcagaacagaaaacagataaagagtggtgtggactttcgtaggggtggcaaagcctgtttgtggaacttgatgtttgtgatgttcacgcttagatttatgattgccccaaaagctttgccccaaaaggtagttttcccatggaagcacttcaggcagtcctgccgaaggtgctcctcccaggcacgtggcacaaaagctgttcagacaccccactagcagatgtacttgtcaccaattccagcaaggtt

SEQ ID NO: 400593 - DNA, 170 bp, Homo sapiens
caaagtcagttacattttatatgccaatagttacgtatcagtcaaaaagtgaaataaggtcaggttcattacaggctcatgcctgtaatcccaggtactcaggaggctgaggtggaaggattgcttcagcccaagagttcaagattacagtgagctatgatcaccctggg

SEQ ID NO: 400594 - DNA, 325 bp, Homo sapiens
gtttctagggctgagactctggaaatatattaattttaggttgtttctgatggcaaaaaaaaagatccgtctattacaatctcttgcctgtggagatgagaaaaaattcttcctgctacctttgactgaaataatgcagttagcaaagatttaaatgacaagagtagaagtgtcatctttttgtccctttgcctctaggcaggactacagttaagccatctcaggaaagagaagagtgctattgctcccaaaactctccaggtgagaatgataaaaattaaaaacagcaagtgagaaaactcaggggccctgaaattaataaagg

SEQ ID NO: 400595 - DNA, 417 bp, Homo sapiens
tgatagagatggggtcttggggggctgcctccaccactgcctgccctgctcagcgctgacccacttcccttgaccagagttttggcctctctgaatgggacggtcgttttagtcctgagggcccataagaagcccagtggcggctgggtgcggtggcgcacacctgtaatcccagcactttgggaggccgaggtgggtggatcgtgaagttaagagatcgagaccatcctggccaacatggtgaaaccccgtctctactaaaaatacaaaaattagctgggcatggtggtagtcccagctactcgggaggctgaggcaagagaatcgcttgaacctggtaggcagaggttgcagtgacctgagattgcgccactgcaccccagcctggcaacagcaagactccgtctcaaaaaaaaa

SEQ ID NO: 400596 - DNA, 174 bp, Homo sapiens
gactgtagacagctgaacttgatcctataatcaacagtttacttccaaaggcttttgtataaggttataacatcatggaagtcttaagacgaatttggctattgaatataagatgaatttggctggacacggtggctcactcctgtaatcccagcacttttggaggccgaggcg

SEQ ID NO: 400597 - DNA, 302 bp, Homo sapiens
tcagatgtacacttattgataatcttgctcagttttatcctgcttgttctcccagaattttttgtaaactcaactcctctgtttacagagttttagtcacttttaacaattttttaaaattcagtttgtagactccatttgttaagggaatcaatatcagaagtaatactaaaatgttataataggaaaagggatccactaatatagcttatggttattagagctgggctacctttaatcatggaataatcttatgtataggtgtaagaatgactcactatatgaatacatactaatcatat

SEQ ID NO: 400598 - DNA, 340 bp, Homo sapiens
tacgatctcagctcactgcaacctctgcttcccaggttgaagtgattctcatgcctcagccaccctagtagctgggattacatgctcatgccaccacacctggctaacttttgtattttcagtagagatggggtttcaccatgttggccaggctggtcttgaactcctggcctcaagtgatctgcctgcctcagcctcctaaagcgctgaggttacagacatgagccaccacacccagctgaatattaacattttttattgttattctgataatgaaatttttctgattgttttcaattaacatattttagtttactagtaagcatgaactttaaaaaaa

SEQ ID NO: 400599 - DNA, 361 bp, Homo sapiens
gccacagggtcctcttccaaagtggctctctctcgtggctggcacattggtgctggcagttagctgggggcctcagttcctctccctgtgggtctctccatagagctgcttgagtgtccacaggcgtggcggccggcttcctcaggagcctgcaatccaggagaccagggtgaaagctgcaagatcttttaggatctggccttggaagcacacaccattactcctgccatatggggccagccctgatgcagcatgggaggtgatcaccaaggatgtgaataccaggaggaaacgaagatcattggggccatccaggaggctggctaccacagttgtggttgtgaatattagaagtacaggg

SEQ ID NO: 400600 - DNA, 380 bp, Homo sapiens
ggtctctttttctccagctctaaaatgggggaaaaaaacacctcccccacgtctaaaaaataactcttttacccttgtatcccacagcacaacattcatatccccaccatttcaacttacattttcctttctacctcgttaccctacattatacggagaactctctgctgtcagagatgttgtcttatgcacctttttatctccagcacacgatacagaacaggtgcttaggatgtacttgggaaggaaggaagagaggtgaaggaggcagagaaaggaaacagtgccaagaatgtgctttgcgtaaatgtgaaccttgtgttctgcttctgctctgtccatgagcacactgggtacattaaaattgttttctccttctg

SEQ ID NO: 400601 - DNA, 2696 bp, Homo sapiens
agcggagactgagccctgggaggctacgggctcccccggaaaccctgccaggggagccgggttttgagctcaggcgcctctagcggcggcccccagaaatctgactcgcgaggccagagttgcagggactgaatagcaaactgaggctgagtagggaacagaccatgaggtcagtgcagatcttcctctcccaatgccgtttgctccttctactagttccgacaatgctccttaagtctcttggcgaagatgtaatttttcaccctgaaggggagtttgactcgtatgaagtcaccattcctgagaagctgagcttccggggagaggtgcagggtgtggtcagtcccgtgtcctacctactgcagttaaaaggcaagaagcacgtcctccatttgtggcccaagagacttctgttgccccgacatctgcgcgttttctccttcacagaacatggggaactgctggaggatcatccttacataccaaaggactgcaactacatgggctccgtgaaagagtctctggactctaaagctactataagcacatgcatggggggtctccgaggtgtatttaacattgatgccaaacattaccaaattgagcccctcaaggcctctcccagttttgaacatgtcgtctatctcctgaagaaagagcagtttgggaatcaggtttgtggcttaagtgatgatgaaatagaatggcagatggccccttatgagaataaggcgaggctaagggactttcctggatcctataaacacccaaagtacttggaattgatcctactctttgatcaaagtaggtataggtttgtgaacaacaatctttctcaagtcatacatgatgccattcttttgactgggattatggacacctactttcaagatgttcgtatgaggatacacttaaaggctcttgaagtatggacagattttaacaaaatacgcgttggatatccagagttagctgaagttttaggcagatttgtaatatataaaaaaagtgtattaaatgctcgcctgtcatcagattgggcacatttatatcttcaaagaaaatataatgatgctcttgcatggtcgtttggaaaagtgtgttctctagaatatgctggatcagtgagtactttactagatacaaatatccttgcccctgctacctggtctgctcatgagctgggtcatgctgtaggaatgtcacatgatgaacaatactgccaatgtaggggtaggcttaattgcatcatgggctcaggacgcactgggtttagcaattgcagttatatctctttttttaaacatatctcttcgggagcaacatgtctaaataatatcccaggactaggttatgtgcttaagagatgtggaaacaaaattgtggaggacaatgaggaatgtgactgtggttccacagaggagtgtcagaaagatcggtgttgccaatcaaattgtaagttgcaaccaggtgccaactgtagcattggactttgctgtcatgattgtcggtttcgtccatctggatacgtgtgtaggcaggaaggaaatgaatgtgaccttgcagagtactgcgacgggaattcaagttcctgcccaaatgacgtttataagcaggatggaaccccttgcaagtatgaaggccgttgtttcaggaaggggtgcagatccagatatatgcagtgccaaagcatttttggacctgatgccatggaggctcctagtgagtgctatgatgcagttaacttaataggtgatcaatttggtaactgtgagattacaggaattcgaaattttaaaaagtgtgaaagtgcaaattcaatatgtggcaggctacagtgtataaatgttgaaaccatccctgatttgccagagcatacgactataatttctactcatttacaggcagaaaatctcatgtgctggggcacaggctatcatctatccatgaaacccatgggaatacctgacctaggtatgataaatgatggcacctcctgtggagaaggccgggtatgttttaaaaaaaattgcgtcaatagctcagtcctgcagtttgactgtttgcctgagaaatgcaatacccggggtgtttgcaacaacagaaaaaactgccactgcatgtatgggtgggcacctccattctgtgaggaagtggggtatggaggaagcattgacagtgggcctccaggactgctcagaggggcgattccctcgtcaatttgggttgtgtccatcataatgtttcgccttattttattaatcctttcagtggtttttgtgtttttccggcaagtgataggaaaccacttaaaacccaaacaggaaaaaatgccactatccaaagcaaaaactgaacaggaagaatctaaaacaaaaactgtacaggaagaatctaaaacaaaaactggacaggaagaatctgaagcaaaaactggacaggaagaatctaaagcaaaaactggacaggaagaatctaaagcaaacattgaaagtaaacgacccaaagcaaagagtgtcaagaaacaaaaaaagtaaccgggcaatccatactcattcagtaacacaggctcatttatttaaccagctaatcatttatccaaaggctttccattcttctcccaatatttttttactttaatttttcccacaagttttgatcagcaaataaacagcattcttgttttggaaacaaac

SEQ ID NO: 400602 - DNA, 2669 bp, Homo sapiens
agcggagactgagccctgggaggctacgggctcccccggaaaccctgccaggggagccgggttttgagctcaggcgcctctagcggcggcccccagaaatctgactcgcgaggccagagttgcagggactgaatagcaaactgaggctgagtagggaacagaccatgaggtcagtgcagatcttcctctcccaatgccgtttgctccttctactagttccgacaatgctccttaagtctcttggcgaagatgtaatttttcaccctgaaggggagtttgactcgtatgaagtcaccattcctgagaagctgagcttccggggagaggtgcagggtgtggtcagtcccgtgtcctacctactgcagttaaaaggcaagaagcacgtcctccatttgtggcccaagagacttctgttgccccgacatctgcgcgttttctccttcacagaacatggggaactgctggaggatcatccttacataccaaaggactgcaactacatgggctccgtgaaagagtctctggactctaaagctactataagcacatgcatggggggtctccgaggtgtatttaacattgatgccaaacattaccaaattgagcccctcaaggcctctcccagttttgaacatgtcgtctatctcctgaagaaagagcagtttgggaatcaggtttgtggcttaagtgatgatgaaatagaatggcagatggccccttatgagaataaggcgaggctaagggactttcctggatcctataaacacccaaagtacttggaattgatcctactctttgatcaaagtaggtataggtttgtgaacaacaatctttctcaagtcatacatgatgccattcttttgactgggattatggacacctactttcaagatgttcgtatgaggatacacttaaaggctcttgaagtatggacagattttaacaaaatacgcgttggatatccagagttagctgaagttttaggcagatttgtaatatataaaaaaagtgtattaaatgctcgcctgtcatcagattgggcacatttatatcttcaaagaaaatataatgatgctcttgcatggtcgtttggaaaagtgtgttctctagaatatgctggatcagtgagtactttactagatacaaatatccttgcccctgctacctggtctgctcatgagctgggtcatgctgtaggaatgtcacatgatgaacaatactgccaatgtaggggtaggcttaattgcatcatgggctcaggacgcactgggtttagcaattgcagttatatctctttttttaaacatatctcttcgggagcaacatgtctaaataatatcccaggactaggttatgtgcttaagagatgtggaaacaaaattgtggaggacaatgaggaatgtgactgtggttccacagaggagtgtcagaaagatcggtgttgccaatcaaattgtaagttgcaaccaggtgccaactgtagcattggactttgctgtcatgattgtcggtttcgtccatctggatacgtgtgtaggcaggaaggaaatgaatgtgaccttgcagagtactgcgacgggaattcaagttcctgcccaaatgacgtttataagcaggatggaaccccttgcaagtatgaaggccgttgtttcaggaaggggtgcagatccagatatatgcagtgccaaagcatttttggacctgatgccatggaggctcctagtgagtgctatgatgcagttaacttaataggtgatcaatttggtaactgtgagattacaggaattcgaaattttaaaaagtgtgaaagtgcaaattcaatatgtggcaggctacagtgtataaatgttgaaaccatccctgatttgccagagcatacgactataatttctactcatttacaggcagaaaatctcatgtgctggggcacaggctatcatctatccatgaaacccatgggaatacctgacctaggtatgataaatgatggcacctcctgtggagaaggccgggtatgttttaaaaaaaattgcgtcaatagctcagtcctgcagtttgactgtttgcctgagaaatgcaatacccggggtgtttgcaacaacagaaaaaactgccactgcatgtatgggtgggcacctccattctgtgaggaagtggggtatggaggaagcattgacagtgggcctccaggactgctcagaggggcgattccctcgtcaatttgggttgtgtccatcataatgtttcgccttattttattaatcctttcagtggtttttgtgtttttccggcaagtgataggaaaccacttaaaacccaaacaggaaaaaatgccactatccaaagcaaaaactgaacaggaagaatctaaaacaaaaactgtacaggaagaatctaaaacaaaaactggacaggaagaatctgaagcaaaaactggacaggaagaatctaaagcaaacattgaaagtaaacgacccaaagcaaagagtgtcaagaaacaaaaaaagtaaccgggcaatccatactcattcagtaacacaggctcatttatttaaccagctaatcatttatccaaaggctttccattcttctcccaatatttttttactttaatttttcccacaagttttgatcagcaaataaacagcattcttgttttggaaacaaac

SEQ ID NO: 400603 - DNA, 338 bp, Homo sapiens
ctcttctcaagatccacagcaaataacacattggtctcatttaactttgaccgtcagtgattttcccagcatttgaccactcttccttctgaaacactgttcactgtgtttccattgcaaagtactcttgatttttctctttcttcattcactactctatcaccgtccactttgcaaactcttcctcctctatcttaactcctaatgttggaagtcatttacttatttatccattcatctactgaagaatgtcttggttaatttcatgttttggcaattatgaattaggctgccatgagcattggtgtgcaattttatggacataaattttcaaccgc

SEQ ID NO: 400604 - DNA, 867 bp, Homo sapiens
tggagccaagaataccccttagggtggtagaaaccgcccccggggcactgtgcagtgtggctggctctccagcatcaggagtactggggattgcctgggggacgactcctagggctgggcgcccgtgggccctcccctgctgccactgcggcccacgcaagccgggcctgaagggcgcgagcggcatgggtggggagcttgagggggcgttgggctcccaccaagcgccagatccttgcgcgcctccagcgctcgcccgcgcggctggttcctttgggatgcggaggtgcgacggctcctccgcgcgcgcccgctgcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgcgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtggggtgcggcggccctcagcctttgcttgcctgccccccaggctgtgtgcgtccaggacgtcgccccaaacctgcagaggtgcgagcggctccccgacggccgcgggacctaccagtgcaag

SEQ ID NO: 400605 - DNA, 429 bp, Homo sapiens
tcaaagaccaggatccctagtaagatgttcagaggtcctgggggtgaggacattgacccatcttttttgggggggccaccattcaaccccctgtaggttttattgcattgagttgcataagttcccagtggggctctgaggggaaagagctggccgtggagaaataggatgccttgaaaactgcaggtggatccctgcagtctcacagcccctggaattacacgtacgcttctgtgtggggatattgttcccaagagagggcttctgccagactctcaaggagtctgagacagcagaagggtcagagccctcatatggataggatgtgcgtgtctatcccacacgcgaagcttttcactttaaagtcctgttttctggtgttttttttgttttgttttgtttttgagacagggtttcactcttgtcgcc

SEQ ID NO: 400606 - DNA, 436 bp, Homo sapiens
caccagcccggtgtagggggccgagcctgcgccaacaaaagcgcgacaggggtgacggccgggctcaaggttggcctgtcctttggttttaaaacaaagacggagaattttgtcagtcgggaggcgtccagggagcggaggccggagccagcggcctaggaacacagggaaggcctcggctccggtggcccaggctggccgcggagaagcacgctgggccgggcctcggctagccagggcagcttctcccgcagctgcggcttagggctacaaggaagacccccccagcccccagccgattttctacccagtcaaacacacacacacacagacacgcgcgcgcgcgcgcgcacacacacacacacacacacacacacgcactttcactcaattgcgtccacagtttttggccacctatcccgctgggtaaacaaaa

SEQ ID NO: 400607 - DNA, 458 bp, Homo sapiens
ggtgtgagccaccacgcctggcctacacaggtttctaagcttttacttatatatttgagggactaaaaaaacacctcatgagaaggaaaatataatcacagattttgttactagaattttcaaaagagctttcgtggtataagacatgttgactgaggaagcataaagaactgaattgtggtgttagtttttctatttaatgagtgttttcgtttctctgcttcttaaaggccagtcttgctggggttacaggcatgagccactgtgccaggcctacacatcttatttctatattccaccaacttttttttattactgcatagtattccaaaggatgagttctgccataatttatactgttttcctaagtgtttaggatgttataacagatagatacatatttctttttttgtttgtttgtttgagacagggtgacagtgtgagactgtctcaaaaat

SEQ ID NO: 400608 - DNA, 420 bp, Homo sapiens
cctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtctatgctaaaaatacaaaaattagccgggcgtgggtggtgtgcacctgtagtcccagccacttgggaggctgaggcaggagaattgcttgaacccaggaggcggacttgcagtgagccgagatcatgcccttgcactccagtctgggtgacagagcgagactccatctc

SEQ ID NO: 400609 - DNA, 526 bp, Homo sapiens
cccaagctccttaccatctggtctctgcacaccttccttaccccacccagccctctgctcactatgcagtggccacatgggcatttttctattccttggtgatacccaggtaattccacttcaggctctttacactgccatccctttgccaggcccggctgtccctccaggtcactcaagtcctggctaagggtccttcacttactatgtattctgaagtcacctcccatcaactcacctattttattttcctcttaactttttatcatataaaattatttattgatttgctttttataccatttgtcttcctcacctttccccactggaatggcagatccatgaggacagcagcttcgcctctcttattccctattgtaaactggaatagtgcctgaatttgatacgcatgcaatgagtacttttacaagaaaatgttataaatgtgtaacagcattgaagggtataaacttccttcagataaatttggcaatacatattaaaaattaatactgacgtctgaacc

SEQ ID NO: 400610 - DNA, 572 bp, Homo sapiens
aaaaaaaaaaaaaaagttgacgataacagcactacatcatggagtacatgtcaccgatgagccccaaatccaactgaggcaaccttttggaaggcagtgagtgggaacttgtgttctcgtaggttttctatgccacacttgcccccaggttactagaactctctgtgctgacacgctttcccagaaactgtgttatgcctggtaatggaccctctcaaatgcttgaggctttgtattattttcctttcttttcctgctgccctctatgtttacggcaagtcccataaccatcactggtgagaatctagctgatctcctcaggtccgtatctctgcctagcaattctgggagggatgttttaaagcaccctctttttcaaagtccaaaataatgacctggtgatgtatggctgtgcatggaattgtaaagtaatctgaaaaatgtcagcaaagtgtcaagtagagacctgtcttcctggtgacctttgtttggtcaaatacctaattgtttggcttttagctttgtgtaatctgtgaagtaggataggagatactaggaaattctttcaatat

SEQ ID NO: 400611 - DNA, 123 bp, Homo sapiens
tgaagatgaagaagatgatgatgctgaataagtttgttttagtgcagttttttttcttatctataaagcatttaagccccttgtacacaactcattcctttcaaagaaaaacaattgaaatgt

SEQ ID NO: 400612 - DNA, 854 bp, Homo sapiens
attcttagaaacatagatagaaagaaaactggggatagctactatctgcattgttcttggcattaaattaagtgatacttagaggtaggtaattatgtgaagtcatcatcacggggtttatgtgcctgacaatttgtggttttaatcatctcccatttgttaccaaaaagagatggagtcaactttgggggagttggaaacaaagattctgctgaattaaaaatgtggtagaaagaggaacaccttattaagagaattaactgacttttagctttatttccttaagaaaggaaatgctctatttccactagaaaaaaaaaaggaatataaataggaaacacttattttgtaaacatgtcatttaaatcaacaaggagccacactacaaataaaactacaaaagcaggtgcattttggtaacattttctgggaaatcatttttagactcagagtccttttgtttcttcactttcaagaaaactccttaagattctaaaaaaggaagaaaagatatttagggagggaggaaaacaaatgactttttctttgattttaattagcaccttttaaaaaaaaattaatccttcccctgataggagggttcttcaaaggcaatatctgtttggggagggggtgattcacaagtttgcatttgaggatatgagactgcggtgaatgaggaagggagtaggtggcataaaattgaaacttcatgtgaaaaattccagcgtctattggctgcagcgatttcacttgtataatgagtagccctattccagctcaccctgaccacacccacttggaaagtccagggtgcacttcgcagtttaaatgtctacacaccagaacaaaaa

SEQ ID NO: 400613 - DNA, 472 bp, Homo sapiens
caggtcacttgcctggccccacagtgataatggtttcttccacttaccttagattgcataatccatctttctggataatggaagctgcctgcctatctgggctcttaatatgccttttcttggttttgaggcccagtgccaacattgccttggccctcaagtaagaccctgctttgtgtctgactttgatcctcctcagcctttattcactgtatcatagtgtacaggtcatgcatttgagcagtgaagttttctgaacacagtattcagagctgtgtacataaacctaaataagcacaaatgacatgtataggattgagctgattgtcttaatgaatgcattttataattcaaatgatgtagatgtacagtctctcctatttattttgtaccaatttatttgtaaattttgtgattgttttacaaggtttttgtttatttctattctatttagataaatgatgttctgttc

SEQ ID NO: 400614 - DNA, 508 bp, Homo sapiens
tgacgcgtgggtatcaatatcaaaagctctatcagttgtcaataaatataactgggaatgtcctagaagtaaatggttaccctttttccttcattgctgcaacaagaaacattgttctggtggaacatttcacaaaattatgaatgttttgaaagaaagaaatatgaaatcccttggattttactaatatacacagttctcataatatacaacttatttaccatgctggagaaatagcaaccataaaaacagctgcaattaaaatgttactaaagcttttgtacaaatggtagattattaaaaacaaaatgttataccgataatttaagggacaatattgagtttctgtatttttccctttaaaggctgtaggtttatgcttgactaatccttttgacagtatccctggcaataatattttttgaagtagttggtgttcaatatttgtaatttcatgtttcccaacagtctgtttttccttgtttatttaaataaaaaactgtaaaac

SEQ ID NO: 400615 - DNA, 328 bp, Homo sapiens
gagacacactgtgccaggaagggctcgaataggggaaaccatcagcccagctgagcacggccgaccctccacttgcaacctgcacaagtcagaattgagttcctgcccagaggagcctcacacaccagtgaaggcccactagacagggggtattcttctttgtaaccccactctctggaggtactaagcatagagtaagttattcaatgtggctgaacaaatatagcctatgcagaatgccgctaatgcctcaatattttctccagtttttccagggcattcttaatttgagactcatggccaatcaataaaccctgatttttggttc

SEQ ID NO: 400616 - DNA, 760 bp, Homo sapiens
tatatgttatatataaatatataataacgtatagtatattagaacttggtatgagaaagatgttattccttattgaaaagttaaagtagatgcatacttccaaaataaataccaggttgatcaaatactcaaatgtggaaagaagaggttaaaattatcagtaaagatgaggagcaatgacgcatgcctgtaaccccagcattttgggaggccaaggcaggagtatcacttgatactcatggctggccatgagttcaagaccagcctgggaaacatagcaagactctgtctctacaaaaaacaaacaaacaaaattaactgggtgtggtgctgcatgcctatagacccaagttactcaggaggctgaggagggaggatcccttgatcctaggagttcaaggttgcagtggactatgatcacaccactgccctccagtctgggcaatagagaaagaccctgtcttaaaaataaaaaataaacatgttcgtgactaatccttttccccaggccaatgcagagtgaatgtttaggggaaaaaatctaagttggcaagtttctcacttttctgcagtttttgttctctctttagttttcctttgggactttcaggattagttgatccagaaggcaaacaaaaggatttcgatagaagataatataactgattcccaggaaataggacagagacatgcatcagagtttcagctggccttgactttcagctgagagcctcttgagcaccggcaggtcacaaaagca

SEQ ID NO: 400617 - DNA, 1031 bp, Homo sapiens
cccagcactttgggacgccgaggcaggtggatcatttgaggtcaggagttcgagaccagcctggccagcatgatgaaacctcatctctactacaaatacaaaaattagctgggcatggtggcatgcgcctgtaatcctagctacttgggaggctgagacaggagaatcgcatgaacctgggaggcagagattgcagtgagccgagatcatgccattgcactccagcctgggcaatagagcgagaaccagtctcaaaagaaagagttaatttttgatgtttataccaaaatatttagcaatctctaatgtattttgagaaggaattatatttgtgaaagaatatagtttttcaaaatgacatagatattgtaggaaatcggaatttttaaaacatgattgaaaacaagatgagtttcactcattagggtaaatggaaaatttctgagtatgatatcagcaaactctaagattcttttaaaataattgtgcaatagtcatttttctggcagagtcaattcattcttctggttcaatatattctagacaaatgaaagaaaaggaatgttgatctgtgtttatccttgtaatttttctaagctttatatacagttttataaatgggatgaattatgtgcacgataccatcaattctaaaaactacctttttaaaaaccttttggaaatcaggattgcagttgataactacctaaactcacttccagccctataaaaattacttttccaaactaaggagcatcacgcattatgcattgtcagccaaagttctgtagtgtcagcgtgatcattcgttgtgtctgtagtgtcagcgtgatcattcgttgtgtctgtagtgtcagcgtgaacattgtgtctgtagtgtcagcgtgatcatttgttgtgtctttagtgtcagcgtgatcattcgttgtgtctgtagtgtcagcgtgaacattgtgtctgtagtgtcagcgtgatcattcattgtgtctgtagtgtcagcgtcatcattgtgtctgtagtgtcagcgtgat

SEQ ID NO: 400618 - DNA, 477 bp, Homo sapiens
tctttgtgaaatcaagcttattaaatgtcataagtcatagataagtatatgaaatgtctaacgttcaaaccttgttttcttaaaaccttacacatcatataggtccttgtaagaggataaacaaaccggctagcctttcctggggcttttttagtgatgtgtgcagtcagttatttggtgccttgtgggtcatgatttccatttcttctgtgtacaggcataaaagatcttctgttcttatacaagcatgtaaatccaacattctcattgtctcattttattcttgcaatgaccctgtgaaatgtgtagaagcagcacatcctcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatca

SEQ ID NO: 400619 - DNA, 517 bp, Homo sapiens
tacaattggaaaattaatgtgaagttcagaaagcattgaagagaagggaaagaataatcaataaagaagttttggccagagttgagataaagctatacagatccagacctcaggggctgcagtgagaatggaaaagaagagtgaaaataaaataaattgttgcaggagttggcagaaattgtttactgacaatttaggaagatgccaaaggagagaaaggagataaggtttagcacctggtttctgattaaaagaataatttcgtgactgagagaaataagagataccagaaagagaaaggtggcaaatttgacttcagatatgggaattttattttcatgattcagggaacttatttctcttggtctactatgtattcccaatgcttgatccatggtaagtttgtaattaatgtgattgaataactgaaaaatactccaatcagaaactttagcaaaatatgtaagtgcagataaaccaaaatcaagtcatctttgttttgtacatcatctcttcc

SEQ ID NO: 400620 - DNA, 397 bp, Homo sapiens
gctgcttctcccccgggtctctgagcgtgcgttccgtcacctgcacgcgcactggggcgttccttcattcatcctgggcttgctggcccaactgccttggggccacaggtggtggaagcttttaccggccgctgtccgagcactccctgggcagcctccgtcctaagacagaggagaaaatactggcttcagaaaacccctgggccaagggaccctcgggggtcatgcgtggggctggatcccgcagccaggccctaaccaccaggttctcctgtcgctcggcggggaagccctgcgcttggtccccacccaggaggacgatagacatgaagaccaaggtccggggctcggggcggatggtgtgggtctccgggtcgcccaggccctgtcccctccc

SEQ ID NO: 400621 - DNA, 641 bp, Homo sapiens
caactatggacttatttaagaaaaaaattattaatacaacagaattgcacatatccacaattattttgttcaggtttttcccatcaaaaccttttcaaatatgaaaaaatcagaattggctaagtaaatttagtttcctcttctaccaggcttgcaaagggagggcttccacccaagccacacctacatctctgctccaagaatttgctactgtatacacaagctacatggaatattgagaaaactgatttaaaatgtattcttggaaagtggcctctgagaggacttaaatagcagttaattcttcagaaaaatgccaaaccctgagtgccaccatgggcaagtcagctatctcagtctttcctcctaaagtgagcgttgaattttatactctgtacccaactgacttcaatccatctttattctctctaccattttcatatttaaataaaaccttttgctcttatcaaaaatcactttttaggacaagctatggtaaaagaggaaaccacgaaaatctcatttaatcaactgaaagaaaatatacaattaatttgcctgttgccttaagttgaagtgttttaatacattctcctgtatttaacgtttgcttatatatttttttcccttttggtttattc

SEQ ID NO: 400622 - DNA, 694 bp, Homo sapiens
gtatctcttttttgctgtttggttaatgattgagtgtagtgtgtgttcttatcagtttaatatctggtatgttctcctgtttgatgaacgctatattaaacgcagttttggaactgggagttggagtaagagtttactctatctagtctacgcatcgccattagtgacaaaaacaggtttgtaattttggaaacatcagaaggttgtttccaatttcacagcaatatggctaaaaaagaaaaaacaggtatgctagcagtttaagaaacaggggtctacaactttgattaaattttccaaaacgaggtggctgacacacgcaatcccagctctttttgaaagaaaatggcttgagcccacgagttcaagatcagcctgagcaaatatggcgagactcagtcttttgagatagtgcgatcctggcttactcactgcatctttggactcctgggttcgaacatccacatcagcctctcagcagacacgtgccataacaacgggctagtgtgtattttttttgttttcatatgtatatatggtttttgtttttgtttggtagagaggggtgtttcccccgcgttacccagactagtctcagactcctgggatttgggctttgggatcaagcgatcctcacccccaaccccaaagtgctgggattacaggtatgagccactgcacctggcactctacc

SEQ ID NO: 400623 - DNA, 340 bp, Homo sapiens
ccaccgcgcccagcctagaaaacatttttcaaagaaactaaagaagacctaaataaaaagaaagacattttgcatgcatggattgaaagacttaacgttaatatgtcagtgtttcccaaattaatctgtagattccacacaatccctgtcaaaagacttttttgtagacaagtggacccagtagaaatacaacgaacccaatataggcaaaataatcttgaaaaaaagaaagaatatagttggaaaaaatatttgttttttttttgttgttgttgttgtttttgagacagagtcttgctctgtcgcccaggctggagtgcagtggcgcagtctcggctca

SEQ ID NO: 400624 - DNA, 446 bp, Homo sapiens
attaacattaatgttaacatcttttttttttttgaaacggaatctcacactgttgcccaggctggagtacagtggtgtgatctcggctcactgcagcctttgcctcccaggttcaagcaattctcctgcctcagcctcctgaatagctgggattacaggcacatgccaccacgcctggctaatttttgtatttttagtagagacagggttttgtcatgttggccaggctggtctcaagctcctgatgtcaggtgatccgcccacctcagcctcccaaagtgctgggattacaggcatgagccactgtgcctggccattaacatctaattatgcattgagtttgtgccagaaccgggactttaatttgtgcctactgatttctcccagtccagtgctctttgcattgtgttatgtgactttttaggacaatgttgtcatgtaaacta

SEQ ID NO: 400625 - DNA, 249 bp, Homo sapiens
cggcacgaggtttatgtccacaattccttgcctcctcattcacacagagcattcacaataccctgtgaacacagaattccagtgggctcacaaggtgcagaagtttagtgggaatcaaagtgagtacaaagtattaagaaaagtatgtctgtggctgagcaagccggggcactgacagcctgaagagaccacattctccattggaacaggaacttgttttgagtgcagaaagatggtgaaggcatgcta

SEQ ID NO: 400626 - DNA, 429 bp, Homo sapiens
aaaatgaatatctaagatgaatgtaatatgctctgtgacagaattgtaactagctcaatgggagcacagactggtgagctgctaatggaacttggagagtaggcctcactgaacttcccatttcacctgcacattaaaataccagtgctggaaaaaagaaaagagaaagggccttatacttcccgatttctagtgtctatcctatttggtcatatattacaaattcatagttaccttttagtttttccagcacaaagtgaaaattggatttgtccccttaaggaggagaaaagacaccaacaaggaaataagtaaaattgactacaaggtagacaataatacacgataaagagagaaactagcaaagagctcaaaggcagaaggcaagacttttgaatggaggcaagatgtggtatttgaaccaaggat

SEQ ID NO: 400627 - DNA, 237 bp, Homo sapiens
caggggtaagttgtatgcccatcagcttaggtttgggtgactggcagatggcagaaaataagaaactagagcctaggcagcatagtgagaccctgtctctacaaaaaattaaaaaattagccagtcgtggtgatgcacacctgtggtcccagctacttgtgaggttgaggctgcagtgagccatcattgcaccactgcactcagcctgagtgatcgagtgattctcagtcttggtga

SEQ ID NO: 400628 - DNA, 415 bp, Homo sapiens
ctttatttgaaactagcctgttcacaggaagagtgacccgcagcagcttagtgctctgcctccttcaagctttgctgtctccagtttttccttagtttctccttctcctcaaccaggctgtgcccgctgtactgtaagtctcagttttcctcctctcagtagagtttactccaaggagaggctaaactcctcatggaggctatctgtaccggtccagaatgaagaaatggatgcagaaattaaaaacaaaaaagtatatttcctaatgccctgttgctttatccaggtaatcacttacatatactgcatgtgttttagttcccaaaactaattgtcttgaacaggaaagaataacttctgtagtgtgttgatgatagcaatcaaagactaaaataaatgacagactttcatagga

SEQ ID NO: 400629 - DNA, 323 bp, Homo sapiens
tctccctatcccctcttctttctttcctttcctccctctcttcctctctcactcctatccatcaaacctatatgttttgcatatccattatgttctaggtactgttttatttttggggatcgagcagtgatgaagacagaccaggtctctgctctttcagggttttctcttgcttctttacattaattctatattcaactataaaacaaaatttcccactgaactgcttgtcccttgccaactgcattcaaaaatatccatttgttttccagagggccttggaaagctatctgggaagtttgggctttattctgcccgccatg

SEQ ID NO: 400630 - DNA, 553 bp, Homo sapiens
agttctgtgggatgagtgaagtgggagttgggggttgagtgatgggggaccgagaggtcagtggacgaggttctaggggctcactggtgaacaaagttatgggggctaagcaggattaaatggggcttattaaactttgacttttacacgttttccagcacagtgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgaggtgagcagaaggaaggagaggcacctgcgaggtctcacctgaccccgggcctcgcccaagttgggggcgtgggaggaggggtaggtgcggggtctgagggagatgggggtaaaatgtaattgggataatagttttagagtgtagttttttttggcatttaataaataacatttgaatatatagattaattctgaaataga

SEQ ID NO: 400631 - DNA, 397 bp, Homo sapiens
ggaagtgcttgttggggccaggctttgtaacggtctcctgagcagcgagcagaaaatctgttatcgagagagatgacctgcccctaaaggttcatgcgcatccctcagacccctctttagacgcgccccgcttctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaaatggccaaaccccaggggctagtgacatttgaagatgtagctgtggatttcacccaggaggagtggcagtacctgaacccaccacagagg

SEQ ID NO: 400632 - DNA, 407 bp, Homo sapiens
agctggctgctagccctggatcccttgtttcctgagatactcaacttcccagcctcccttgcagctagtggtaatcatgtgacccacttctggccagtaagatgaaaaaaggaagttcactggactggcagagggagcttgggagggcttttgctgatgccacttgttcttcttgccataaagggccccactcaaggcaccatcctctcctgggtggaggctacagcctctgatcatctgctgtatgatgattcactgtgatggcaaagtgggaggagatgctgatcctgaaaacagtatttatggtgcaaatctcatccatgcaacaggacaattccagggcttacgtcttctcctcctggagcctccattgctctcaactcaataaacactaaataagacttgcc

SEQ ID NO: 400633 - DNA, 2188 bp, Homo sapiens
agctggctgctagccctggatcccttgtttcctgagatactcaacttcccagcctcccttgcagctagtggtaatcatgtgacccacttctggccagtaagatgaaaaaaggaagttcactggactggcagagggagcttgggagggcttttgctgatgccacttgttcttcttgccataaagacggtgtctgacttccaggcaacaatgcacacagaagttacaagtgtggatactagagtcagagcctggattccaatgctgcttcttaacagctgtgtgactttccacaagtaatgcaacatctctgggtctctgtttcctgttctgcaaaatgggggtactgtctacttgccccagggacctgctgtgctgaggatcattcccaggaagcacctagcaccatgctgggtcctggcaagccactgacaaatgttcactgtcacaatggccctgcttcctctggtgctcggcaccaggctgacatcgagtacacagtcaatgaagaaacaaggagactctgcaaggagatacattaggatgatgtactgacaaagccttgggaaaactgctggtgcctttgctggggggaagatttccagatggagctcctcaggatggcctgccaatccaataaactcaggttcctagaaagggcctcccccaacccaaccccacccccactctgtaagccccacccaaaccaggacagcagcaattctccccttcccctggtgtgccttccccggtggtctgtttctttaggacaggaacgcagctgtctggaaggcacccagggaagccattccttgggacatgtcccctgacccacccccggcaaggctgggatgacagaaggacaaacccagccaaacatatggacccgtggcccaggataggcaacagctgggccactgcctgacttttcttctgctccttggaatattctggcaatgagaagacatagtctcagcaacttatagacattttcccaggaaatcctaaccgctaagggaacaatttgctccattctcacacatttcaatctacttatttggaagaccaatccttgcgtgggcatgcacgcacatgcgcgcgcgcgcgcacacacacacacacacacacacacacacacacacccttcatgtggtcttgtgtagaagtacacaaacctgataatagcaaccactaatatttagtatatgctaagtaataaaagtagctactatagtcatcatctcatatagtcctcacaacaagcattgagacaggggctctatccacatttcacagatgaggacacagaggtgggctgcctttcacagaacaagctgctagccatgctggggctggcgtcggagcccaggtctaagaactctggtacaaggaatccactccctttcccggatttgcctcctccacctgtgcttaaggagttaaccttgtcggagaggttttctttccttggttatgttttctattctttgggtaagtttgacaaagtggggttctttttcatcgccagagtctgtgtccctggaggctgaggaaggaaccagaagttgcactttccaacatggatcgcctgctaattttccaaggcagctcagcccctgccagcgtcccctccctcctttgggctgagggcccaggaacccagcctcaaagttcagcttgcttcctccagcacgcacatttggaaattgaaatttcccacattttcaccacacaaaagccaggttgtatttttgttctcttcaaaatatgccaaaggaatttttcctaccccttgaactttctccaaaaataagtagaaaaagtcaagaccattttgccctgtaagctgagaatagaaaaatcaacatgcagggtgccatttccaggatgttacgaaacagcgaacatgtgaatccgtctcaacaccatttggcaactttggggatacagtagatgatatttctcacccacaaactcctcactgagtttatattaacattttgctttttttttttaaaaaaaaagaaaaaagattctgaaaaaggtaagaagccttgataaattaccaccacctggattaaaattcagagtcagcacactgaccaccagcaaataaaacatgaaactatacagataacttagtaaaacaaaaaacgatagtggcccaagataaattaaacttgcagcataa

SEQ ID NO: 400634 - DNA, 846 bp, Homo sapiens
agctggctgctagccctggatcccttgtttcctgagatactcaacttcccagcctcccttgcagctagtggtaatcatgtgacccacttctggccagtaagatgaaaaaaggaagttcactggactggcagagggagcttgggagggcttttgctgatgccacttgttcttcttgccataaagagtctgtgtccctggaggctgaggaaggaaccagaagttgcactttccaacatggatcgcctgctaattttccaaggcagctcagcccctgccagcgtcccctccctcctttgggctgagggcccaggaacccagcctcaaagttcagcttgcttcctccagcacgcacatttggaaattgaaatttcccacattttcaccacacaaaagccaggttgtatttttgttctcttcaaaatatgccaaaggaatttttcctaccccttgaactttctccaaaaataagtagaaaaagtcaagaccattttgccctgtaagctgagaatagaaaaatcaacatgcagggtgccatttccaggatgttacgaaacagcgaacatgtgaatccgtctcaacaccatttggcaactttggggatacagtagatgatatttctcacccacaaactcctcactgagtttatattaacattttgctttttttttttaaaaaaaaagaaaaaagattctgaaaaaggtaagaagccttgataaattaccaccacctggattaaaattcagagtcagcacactgaccaccagcaaataaaacatgaaactatacagataacttagtaaaacaaaaaacgatagtggcccaagataaattaaacttgcagcataa

SEQ ID NO: 400635 - DNA, 410 bp, Homo sapiens
catatgtattatatatattgcatataatatgtgtaattataatgtgatatggattatagaatgcaaatatatttattaatattatataacacatagaatatatatatatatatatatacatgtgttctcagtaacagtttgttacctatttattgtttctaatgtatgttttattctcccttaaatagatgctaaggtctttgagggtagaaaaaaaatcttctatttcttaacacttataattagtataatgaaatgaaagtgataaaaattataaatttgtgttcaatctcatacttttacaataggccagatattgtcattagtttcccaattaacccagatatttacaatatgagcttgaaaaagttatctaagaaggcataaaaaatgaacattagatattcatc

SEQ ID NO: 400636 - DNA, 306 bp, Homo sapiens
gtgtctcagggaatagggaggccagaggagaggagagagttagaacagctggctggtgaagcggtcagaacacacacaacattaaatttgccatcttaacatgggcatggtttgtggctgcccaaaacaattacaacagtaacaccaaagatcactgatcaccacaacacataataataatgaaaagtttgaaatattgccaagaattaccaaaatgtgacacagagacacaaagtgagcacatactgttggaaatatggtgccgatgacttgctcaatgtagggttaccacaaaatcagtttgtt

SEQ ID NO: 400637 - DNA, 509 bp, Homo sapiens
gacggggcagcattcagggcatgtgaccagtgcgtgatcctggaagccattcacaaggtctttgctctgtggtgctttggcctttgcttcccttcctcctaacccatgacctttaccaaatggatcctctccccattatctgaccactcagtgtgactctttggaaaacatgaggaaaaagtgactgtagcatggattttttctttgtgagtgttgtagagattcacagttgtctttcattgtggttgtttttcagtcattcaacaagcctttactgcagtcagctatgtgcctagcactatttgggtatgttggtgcaaagtcacctcagtgggttattaaagaagagtgagagcgagacctacacatgtctttgctgtgtggttttataggcctctttacagaccagccagatgcctagtctttaaggtctgttctaagagaccctgagttgagatgccttttcagcctcctagagagggcacccagaccaccatgctgccttctgg

SEQ ID NO: 400638 - DNA, 422 bp, Homo sapiens
ccaaaaaacaaagagagttagacatagattaccaaaatcagaaatgaaaatgagagcatcactgctgaccataaagaagaaaattaaaggaaatatgaagagcaacttcatgcaaaggaattaaacaattaaggtgaagtgagtaaattcctagaaaggcacaaattactgaaactaacttaacaagaaataggaaatctgaatagacctataccaagtaaatagattgaatttataatttaaactcttctgacaaaagccaaagcccacatgaccttaccgatgaattgtattcaatatttaaacaagaaataatgtcagttcttcacaaactcttttagaaagtactggaggagagaatacttccaaactcattctgtaaagccaatgttacccttacacaaaagccagatcaagataac

SEQ ID NO: 400639 - DNA, 336 bp, Homo sapiens
ccagaaaagacatactgttctttccaatatgatgtggaagtctgaaagattaggaattgtttggtaagaaaaaaatatacatagctatttgtggatgacaatgccctgacactgttcctcctttctgtccttggttgggggcctgcctcatttctcattgaggggaattccttcatcaggacctgctacgctaatggtcacggaccaatgttctttttgctgtttgaacagaatgcttgccttgtgtatgtccagtcacaaagttcccttgataaaaaccatatgaaaataccacaaagccaaagggcaataaatattgttacatagagcacgttt

SEQ ID NO: 400640 - DNA, 430 bp, Homo sapiens
ttctaaaagagcatacaacccttccgctgtctgcacagcagcctggagcttggcttcttttgttccttaaatcaaggccaggaagcagagccaagagcccctttcctccctgcttccccttgcggaatcatttccaattcagtggcagtgagaaaatggtcattcattgggctgtgaggtcagaagtctccaaggccccagcaaggacagaaaacactggaagggcaaaatgagagcccttggcaggtgctaaaggaggggccacagggtaacacctcccatctgggggagcttaagaaagaagctgggcacatgtagtcttagctactcgggactccaaggagggaggatcacttgagctcaggagttcgagactagcctcagcaacacagtgagattccatctctaaaacaacaacaacaaaccaaaa

SEQ ID NO: 400641 - DNA, 410 bp, Homo sapiens
tacaatcaggcctgaggctatacttgaccctcgacaagtgaaaatgtcagtatttatggtaatggcttctgagcatctctcatctttgccagcaagtctacagcttttctaccagtggattatggattcaaatttgagaacaagccattaaaagcaaagcagcttcacagtgacagcctgacacctgtcatatctccaaggccacgtcgctttttgtattcctgaaaactcttgggctaaagagcctataaaatcaaatccccttaaagtgcggcatcagtggatttcccaagcccaaaaggtttaaatgccaagcaagtcaaaggtggttacttctgccacttcagatttattcctcctattgatttatcctaacatatgacattaaagttacagtattttatgtatga

SEQ ID NO: 400642 - DNA, 407 bp, Homo sapiens
ccacgccacctcttggctttctgcccactaataagattgttgatgttgatgactgggcacaggctgcggcccctcctgagcccctcagaagcaaaactggaatgagagtggggagctgcccgtcttccagcaggaggcgggccccgactcccgccgagcgactccgggccccgcgcggtccctgtcaccttgtattctcattgcccgttccgcggccgtcagctcccaggattgccccatttagcaaatagctttcgacaacccctcttcgtcagacgttgtaggtgcagaggtgctggagtggacagaggcaaggcgcccgctcttggggagctcacgttctggtgggaagagacagaaacacattaagaacctatctgtaaaataaagataatttcaggtgcaaa

SEQ ID NO: 400643 - DNA, 441 bp, Homo sapiens
tcaaggtatggtccaaggaatcctggaggtcccctagacatttttggcgagtctacaagtgcaaaactatttttataatactgagacattctttgccgttttctttgtagtgacatttgtacctgtagtataaaaacagtggtggataaaacttctggcgctttagaataaaccaggttagagtacttcactgtcctagtaatcattgtattattcactgccatgcactcagatttttttttaagtttcacctaaatgctcttgatgaagaagtaaaaaaattttaaactaaatctctacctttgtacacatctttaatatactgtaacaaaatgggaagtatgcttaaaacactggcgaggccatggacagcaagcctcccagcactttgggaggctaagtccagcttgggcaatgtagtgagagcctgtctctcctatt

SEQ ID NO: 400644 - DNA, 425 bp, Homo sapiens
ttccaaatgattcgaaatctgattatgtctgcaacaaatcctggtgggatataaattatcacaagttttaatgtactaggagagagagggtacctggacttttcctcatcttttctgttgtgagttactgactgaacatgtgtcaatcaacttcccaccacagcagaggtaacattttaaaggcccagctaaggagcaagcatgacttgttcctgtggaggcaccagatgggtaactgggcccatggcaaatgaagaggaagggactgtgatgtcctggagcagagccacgctgggctgaaccagtggtggatgggtgtgactgaaaaagcaagtccagcctttaggtgcctggactttgaagtcaaggctggctggtggagaacaactgtttcaaaaccaggcatcagaattagattgaagtta

SEQ ID NO: 400645 - DNA, 431 bp, Homo sapiens
atccttcctgtccttatcctgtccttttgcacaaatgagcagatacatgtatacattttcaaaatacccttcttacctatatgtagggtagcatactgtagatagtctttggcactttactgtatttcacttaacaaaatgtcttgggaaaatctctcctggacattggtctaggcaaagaattcgtgactaagacctcaaaagcacaagcaagaaaaacaaaaatattctgaatcaaggaccagagaaaaagacaaacaaaacaaaacaaaagtagacaaatgggacttaattaaattaaaaaacttctacacagcaaaagaaataatcaacaaagtaaacagacaccctgcagaatgggagaaaatatttgcaaactatgcatcccacaggggactgatatccaaatttacaaggactcaaacaactca

SEQ ID NO: 400646 - DNA, 482 bp, Homo sapiens
aataacccatgcaaaaagacattgaaaaatatgccgaactgagtgacaatggaaacacacttatcagattctgtgagctgcaacaaaagcagtatttagaggaaaattaatagtgttaaatgcttatgttttaatacacaagttaataataatagtttaaaagaaaaacacagaataagctttgaaagatgctgaaaaataataagagaaaaaccaatctttcattccagtttttctttttgcataaactattcttcaggtaaccaagacattgagaaaggatggctccctttatagatatagtccagctaataaatgcagaagaattagaatataattctgtaaccactgataaaataacatattcacataaagatgtcagtagctggctgttaacatcacataaaggaaaacaaccagatactatgccctacttcagagaagtgcacatcactatgtatgatggattactaaaataaaaa

SEQ ID NO: 400647 - DNA, 416 bp, Homo sapiens
aatatttcaacatactatcaataactaatagaataagtagataaaatacctttgatttaaaagatttaaacaatataatcagcaaatttgaataggcattatatggaactctatactcccaaacaagaaagaatacttattctttttaaatacaaaagtgaattatttataagtgaataatagtgaaaatacagttattaacacttgaaggaataaagtgagttgcttagagagaaatttatatcccatagagatatagtctctaaaaaaaaaaaactgccagaatggtagcacacacctgtaattccagctactcaggaagctgaagcgggaagattgcctgaacccaggagttccaggttacagtgacctatgatcatgccactgtcctccggcgacagagtgaccttgtctca

SEQ ID NO: 400648 - DNA, 179 bp, Homo sapiens
gaccctgtctctaccaaaaaatattatttcaattcatttctggcttatccttccagcatttcctttttacaaaggatagtttccctatccttctgccctaagtatgaatagacaaccaagaatcttccagcatgtgggaaaaaccagcaccatgaattaaaatgaccaaaactaaacta

SEQ ID NO: 400649 - DNA, 289 bp, Homo sapiens
atgcattctggctctttggaagcccttcaggtcttacactgcacccaaaatccaaccccaagtgaccacagcagtgggctacaaacagggtcccagtgccccagggctgtagcctgcagcttagaagtgcactgctggtggctatgctcgtcacttgaacaaggaaggagactacactctctgcagtcttggagagctggggcacacaaatgcacgggcttgtgtaggttcctccacagggttgtttcagtgaaggagtggcctgttgtcctgctttaagtcgacatat

SEQ ID NO: 400650 - DNA, 3013 bp, Homo sapiens
  misc_feature (43)..(43): n is a, c, g, or t
  misc_feature (1557)..(1557): n is a, c, g, or t
tcaaatatccagttttaccttctgtggtctgtgaacatggcgnctataattttcttttaatatttgtttacatttccttgtgttttaatatttgatcaatttttgtgactgtttcttgtatactgaatgtttatctctacatatcaattacattaagctcattaactgctcatgttacataaatatatgtatttatttttttctactttgttctgtcaacttctgaaagatgtgtgctaaaatctcccactatgatcttggtttttatcacattaaaaaaattattagatttcttctctttatgtcaaagctatattgctaagtgaattcatatctataaaacaatttaccaagatgataatgaaatatctcttcgtttcttttaattgaatgagtttttgctttgaattctcttgctatgcctactactttttatttgcctgattaatctttttctcaaccttctagtctatgttttatgtgctccttgtaaacagcaaacatttttcaaactgatttgagaggctaccctttaataagtgaatgcaaccattctacattgtatttctatttctcatgttttcttatagcttctgtattttcttttccagctatatgctgcctttactgaattttctatgttccatttttctttctccctaatggttttgaacgaaaatattgtttcttttcgtctagtaattatgcttatcatgagtactgcatgtctaaaaaatgtcagttttataatttgggcaggtattgaactcttaagtacaaaattattttcccaaagaattttaaaatatactatcccactatctttttgcatccagcattagtaattataggattattgctggttgctactctttctgtctatcctcagtgtctctcaactcgccttttttttcttcctgtttgtcctttcttttgaattgctaacttcaaaaagctctaaagttttcttttttgatgaatgcagtgtcatcctgcatgtctctgaggacagtaattatatttattctaaaactcttgttttgctttctttattaactcttatcccttgggcattagttcttccatttatatagtttggtactctccttcatgatattagttttcttcaaatattttgtgattctgggttgtgaccctatcttttttggactttagagatatcctattagtctgtgatggctgtatgtgattacagtagcatgagtcgggggagaaagatgtgccaccgggtagttaaaatggatagttagtgttctaggggtttcctatctgttctggatattgacagcattgggagtactcccttggcttttaaatcacccaaatttcttgtttttgcatgtcaaacaccaagaaaaaactgtgaaggtagggagaggtagttctacatgtctccttgtccaggaggctagacataaagaatccccaaatagccattcataccttttgcagtattccagtcctacacatattttagattatagttcttatctgcattctaatgccatttatcaagggctctccatggtttttggnagttttgctgtttcctatcacagttgtatttaattggtactatatattctatagagagggagaggaggattatttttaggaatgtgtagtagcaaggagaggttgcagcatgttctcaatgtaccatcttgtactgaagtttcaaatagatatgttttggcagagataaatggacaatattgtacatacttttaagggaaaatgtgcttttttactatacattcccttctactaaaatatgatctcataatagtaagaagggggtgtttatccagtagtttctaactctagatgcacattactcaaatatcaaagtgtaaccccagaaattctattttaattgaacaagggtaagaaacactggtacagtagcagaaaaactgcaggttagggatcagactaatttgagttcaatcaccacttactaaattatatgactttaggcaaaaacaacattttgagccttagtttcttcagctgtaaattgggtttacaaaattgtggtgaggactagagataatataagaagagagactagtatcatgcatggcaaacagcatatgcttattaaatgttagctcttctaatgctatgtataagtaagtagatgaaaaacatggcataaaggaagatcaagtgaaataggatgtcccttcatacgtcaaaatcttacaatgactaaaatttaattccagatgtcacaggagctgacaatcattaccagatttacaaactgagcaagattatgggatttacagagtattcctgtcacatattacatacctcctgggctcttttaacattcttctttcaatgcatctttcaaagaccactctctaggaaatcacacaactgctcaattccacatttccaaatttgagagagtaaaatctgtcaataataatggcaacctaattatatgtttctgtttgtattttttaaaatactatgacaaatagatgagcacttttaagttgcaggaaataagaataactagaaagctgtggatcccagaaattaaagaaactttagtgtcttccaggcaggaaattatccaaacctaattacaaccagctggagacagctccattttcaggaatgcttagatactagcaaaacacagtgatgcccatttgctgacaagtaaatgctcatatctttatcatctgtgtcattcagaaacattcatatgccacttggcaaaacaacttcttaataggtaatattcattgaattcttataaaagttttaattcatttccaaatacaactataatacttcactatttcaacattagagaaaaattattttctcttgtttctttacaaatgttttgtttggctgggtgtagtggctcacacctgtaatccaagccctgtgggaggccaaggtgggaggatcatttgagcccaggagttcaagacaagcctgggcaacacaggaagtccgtctctac

SEQ ID NO: 400651 - DNA, 469 bp, Homo sapiens
ctcctaaaactctgagaattccttgagtgttgagtgtctttggtatgctaatgagatgactctcaacagaggggctcctggatagcttcaatatgagagctggttttcagaaacaccaaccttgtgattagagggttggaactttaagcctcacccctggacctctgaggacaggagagggactgaagattcatctaaccaccaattgccaatgatttaatcaatcatacctatgtaatgggaccgctataaatatcctaaacaatgggatttggcgagcttgccagttggtgaatacatcaatgtactgggagggtagagcaccccattcccttgggaacagaaactccagtgttcagtacacttccagacattgtcttacctaaactttttcatttggttgtatatttgtatcttttataacatcctttgtaataaaccagtaaaagtaactgaagtgtttcttcga

SEQ ID NO: 400652 - DNA, 522 bp, Homo sapiens
cacatatattttccattccaaaagaatattctttccactccatcctgaagggtcttgctctgtcattccagctggagtgcagaggtgtgtgatcgcaactctctacagccttgacctctgagcctcaagcaatccttctacctcagcctcctgagtagctgggaccacaggataatgctggtctcacaaaatggattgggaaatgccacacctctactttctgaaagagtttacataagagcctcactctgtcgcccatgctagagtacaatcatgcaatcttggctcactgcaacctctgcctcctgggttgaagcgattctcctgcctcagcctcttgagtagctgggattacagcctctgttactgggcatggagtcatctgtcttctatggagcacctctgtcttttggtcaaagagggaaaatgaaatcctggccctatggatactgggaagcatactcaagtatctctgagtttgagaccagcttgggcaacagagcaagacgccgtgtctacaaa

SEQ ID NO: 400653 - DNA, 190 bp, Homo sapiens
tcgcattcacagcacaacgtttctctttcccaaataggcatgttgttgtttcaaattaacatctgtgcttactgcagaatagtgaatgccatcttcttttgccccgctgaccctgatggtgtcactgaggctttcaaagcagagtgaccaggcacagctatagttttctgcagtatcaggaaaggggtgg

SEQ ID NO: 400654 - DNA, 267 bp, Homo sapiens
tcacacctataatcccagaagtttgggaggtgggtggtttgcttgagcccaggagtttgcgaccagcctgggcaacatggtgaaaccccatctctacaaaaaattatttaaaaattaactgaatatggtggtgggcatgtgtgtagtgccaacttgggaggctgaggtgggaggatcacttgagtctaggaagtcagtgctgccatgagtcctgatcacttcattgcattctccagcgtgggtgacagactaagaccctgtctcaaa

SEQ ID NO: 400655 - DNA, 451 bp, Homo sapiens
tctttagatattaaatcatatttatcagtggcacaatatacccactacattccttcctgtcctactgttcttttatctccccaaccatgttaaagaatttagatctgtgtttagagctccgtcctcactgtaactacctcaaggcctgacataggctgagtgaggcccttactgttgttgattcaagttcaggatactgatgatgagaccactggctcatctgataagaccactgataagaccatgagctgttcagcaggcacagagcttcaggtttacttggttgctcaattgggtcgttcacacagtgagggagatttctagtttgattgcataaccaaaacgcttttatatgcccagaaagaagaatggataatcgttacacagataatggtgtgtgactattgtaattccatgatgcctctgagaaaaactggtttttataatgtat

SEQ ID NO: 400656 - DNA, 431 bp, Homo sapiens
gcaatggttctgaggtccaccaggcagccgtaggagccagttgtgagaagggcaagttccacaggcttgggctcttagctgaaagagctcctttcagaattttctttttcttctttttcttttattgccttcccatagaagattatagatagctgaagtttgtgagttggattacttccatccataaaataaagactaaaatctttccaccctaatcagaaaaaagcatccttttgtcccactatattcatcaatatgtcatatttaacagttacaattattgacaggcatataaaacattttgtgacagagaaaatagcttcctataaagtgtttattcttttttattgataataagttgacttctctagccctaccaagagaatacggaccactaacaagagatcaaatccatttatatgacttcttac

SEQ ID NO: 400657 - DNA, 426 bp, Homo sapiens
gaagctgagaacaatcatttcttgttccgtaaacacatggcttgtgtgttttatctgtaagtcaattccaaaagttgaaaattagtaacagctttatattatcatgatcatataaatattagtcacagcagaaccaagtagtgtgctgggtttatacttccttttctataatattcctagcatatacatcaaaaccatatgaatgcttattaagttaaaccacatgaacttgactttttttgtaggttgaaacagtcaaatatgggcaacttcatatggtccaacctaatcagagagtgtcagttgctctccaaattggatgtatctgtctacattcccacctactgctttccatctccaacatctggtgtcccaagaccttcatctgtctaccaatctgatgagtataaaatggtgtggcgtccg

SEQ ID NO: 400658 - DNA, 285 bp, Homo sapiens
caggggccggcacagtggctcacacctgtaattccagcactttgggaggccaaggctgaggatcccttgaagccaggaaatcaagaccagtctgcatggcatactgaaactcccatctctacaaaaattttaaaaaccagctggacgtggtggcgtgcaccagtggtcccaactgcttgggaggctgaagcaggaggattgcttgagcccaggagtttgaggctgcagtgagctacgatcgtgccactgcactctagcctgggtgacacagcaagaccctgtgtc

SEQ ID NO: 400659 - DNA, 512 bp, Homo sapiens
tgagccacagcccctgaccagaactatttttcttcccaagctagcatcttagccaaaattaactagaatgtttctcgtccagttagaaaaaggtattacactttcaaaatattttacttgtttatatcaaaaaaggtgcagcaatatgctgattttgttggaaaaagttacactgcctagaattaaatgtctgatatccagcacagaaatgatgcttcctggctgggcctagtggctcacgcctataatcccagcactctgggaggctgaggtgggaggctcacctgaggttgggaatctgagaccagcctgaccaacacggtgaaaccccgtctctactaaaaatacaaaaattagctggatgtggtggtgcatgcctccagtctcagctactcaggaggctgaggcaagagaatcactttaacctgggaggtagaggttgcagtgagctgagatcgagccactgctctccagcctgggagacagagcgagatccatctcaaaaaataaaa

SEQ ID NO: 400660 - DNA, 739 bp, Homo sapiens
  misc_feature (49)..(49): n is a, c, g, or t
agaattgcttgaacctgggaggtggaggttgcagtgagctgagatcgtnctgctgcactccagcctgggtgacagagcaagactcagtagagacggggtttcaccatgttggccaggatggtctcgatctcttgaccttgtgacccacccacctcggcctcccaaagtgcagggattacaggcgtgagccacagtgtccagccaattcatactttttaaggttactttgtttatattgtggagaatagactgaagagctagagtgaaaatactggttaaaaaacaaacaaacacgtaataaatgaggtgaaagatagtaacttcatctagagtgatgaagaaaagtgcatggatttaagatatgttttggaaattggcatgaaaggatttgctgatggttttacatgaggagtaaagaattaggaatgagtcccaggtgtctgatatgaaaactaggggatggatataatgtcatttactgtgatggggaagtggggtgtggagataagatgtgagagaaattcagaggttaagtttaagacatgttaagtttgaggtgcctgtcagataatttctctcctgggcctggttcttcctttgtatggaagtgatccttgtatttcctcattggtattatcacacttttaaataatgatgattttattttaaaggacttgcaggtaccaagcataacaggaatgaagaaaattctagggcttttccagcctcattgacaagg

SEQ ID NO: 400661 - DNA, 480 bp, Homo sapiens
ggtacccacataattgttcgtggacactaagcaggtattttgcaagagaaatctggtttctttcgtgtttggtgaaataactgaattttcccatgctttaactatgtgtgaggaaataatttctggttcttctgtttattttctctttctatggtcatacatacactcaccgtcttcctctgacagtattgattaccaagcacaattaagcactgagacagaaagttaacagctgaagtggggtcacctataggcagaaaatagattcgtgtctgtttaacagtaacccaaataagaagccatgttaaatagagacaacttttattacaatccttatagcataccttccttttaacattatttttatgatttagctccctccaataggaaatgtttggccacccactggttttgtgctttatatacttattgctttaaatgtgttattaaaatcttaccaccaaattaggaaaaaaaaac

SEQ ID NO: 400662 - DNA, 576 bp, Homo sapiens
  misc_feature (49)..(49): n is a, c, g, or t
agaattgcttgaacctgggaggtggaggttgcagtgagctgagatcgtnctgctgcactccagcctgggtgacagagcaagactcagtagagacggggtttcaccatgttggccaggatggtctcgatctcttgaccttgtgacccacccacctcggcctcccaaagtgcagggattacaggcgtgagccacagtgtccagccaattcatactttttaaggttacttttgtttattttctctttctatggtcatacatacactcaccgtcttcctctgacagtattgattaccaagcacaattaagcactgagacagaaagttaacagctgaagtggggtcacctataggcagaaaatagattcgtgtctgtttaacagtaacccaaataagaagccatgttaaatagagacaacttttattacaatccttatagcataccttccttttaacattatttttatgatttagctccctccaataggaaatgtttggccacccactggttttgtgctttatatacttattgctttaaatgtgttattaaaatcttaccaccaaattaggaaaaaaaaac

SEQ ID NO: 400663 - DNA, 356 bp, Homo sapiens
aagggaccatctcccttttcaagatgcagcctcctgaacaatctgggttccacatggctgccctgatccccagctgcaggtggaaggtcagcagtgctatcctcagggtgacaccctccatagggtcctgggacaactttacccaaaaaggaataatcacaccaaatgcatatatgtgtctctttgtgaagcaagaacttttgaagaattcagatggttttaacacaatatggcatgcagctagaagaggaaatctgggttctcatcaagtatgatattcatcccagtgagccatttgaaatgaaggaggcaaagtctttgtcgacgcggccgcgaatttagtagtagtagtaggc

SEQ ID NO: 400664 - DNA, 383 bp, Homo sapiens
caccagcacgcagcctgggcaccaagagtgaagctctacaattcacaaagagtttcagaatagctgggagataatgggcaaggctgcaatctgatagctcagaggacatgggataggcagtgcattaccacgtttgagacaagtcattgtgttcccaagttgtgtgtctgtccaggccgctccggcagagacgtggagccatggctgtggctcacggctgtgatccgcatccttgtggctgcagggagagttgcagggcaaactctgccctgattcttttgagcccatggtgtgagcatttctactcaaagcaggcttaactgtagcaacatgttactccagaattgtaccttgtatctgttagatttcataggcagtagtgg

SEQ ID NO: 400665 - DNA, 404 bp, Homo sapiens
aattattctgtgtttgtgatagggaggagataatctgttcttttgattttacctaatgccattaaatattcagagctactgaagtctggttttcctgatatgtgagctgggcaggagtgtcaggtaccctggcagacacaattggtgctgttgttatgcttttcccccgctgcccactctcttccccaccccactcccaatttgagagggaaggcccctgacacagaggaatttctgcccaaggcagggagtatccccgtgtggttcctcaaatgtttgcagaaagaatgaaaacaactacacttcttgggacccaggccaacgtcataaggccgacgtcataagaaggttctttcctcttgttatttacaaaataaattgatcccttgtcctaactagaaaga

SEQ ID NO: 400666 - DNA, 2245 bp, Homo sapiens
ccgtgctaccccctccccccgggtgctggctccatgtctgtgtgaccggcctcaggggtagagtccaggcccgacgcggggcgggccagcggcggcggcagctgaggtgagagacggcggcggcggcgcgggcacccggccccccagcgggaggatgaagcggcggaacgccgactgcagtaagctccgccgccccctaaagcggaaccggatcaccgagggcatttacggcagtacatttttatacctgaaattcctggtggtgtgggcacttgtcctcctagcagattttgtcctggagttcagatttgaatacctgtggccattctggcttttcatcagaagcgtctatgattccttcagataccagggactggccttctcagtattttttgtttgtgtagcattcacgtcaaatataatatgcctgctgttcatccccatacagtggcttttttttgctgctagcacatatgtatgggttcagtacgtatggcacacagaaaggggagtgtgtttgcctacagtgtctctctggatcctctttgtttatattgaagcagccattagatttaaagatctcaaaaactttcatgtagacctttgtcgtccatttgctgctcactgtattgggtaccctgtggtaactttggggtttgggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaagcagccaaaggattacctgatatggattcttcgatccttatacaccacaatggaggtatcccagccaacaaaaaactctccacaactttgccagagatagaataccgagaaaaagggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgataatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgt

SEQ ID NO: 400667 - DNA, 2353 bp, Homo sapiens
actggtaattctgcctactagttgcagctactcaagaggccggggcagaagaatcgcttgaggccgggaggtggaggttgcagtgggccgagatcgcaccactgcactccagcctgggtgacagagcgagactccatctcaaaaaagaaaaaagaaaaaaaaaattctagttctttcaggtaacccacatttatttggaatccaaatgaattcactgtgttcccacctcagctcattctgatccagttctttttcatgatttgaggaccataaagtactagtattctttaatgttaaagtaaccgctactttttatatggttgattttaaatgtttaaaatttccttttgtgaatttgctttacagttaccaagttatctcttagcagtttcaataattttgtccaacatgtgtttaacaatgtgtggttgaaaataacaggttctaagatgtatcttttattttgttttatttttccctttaggccttctcagtattttttgtttgtgtagcattcacgtcaaatataatatgcctgctgttcatccccatacagtggcttttttttgctgctagcacatatgtatgggttcagtacgtatggcacacagaaaggggagtgtgtttgcctacagtgtctctctggatcctctttgtttatattgaagcagccattagatttaaagatctcaaaaactttcatgtagacctttgtcgtccatttgctgctcactgtattgggtaccctgtggtaactttggggtttgggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaagcagccaaaggattacctgatatggattcttcgatccttatacaccacaatggaggtatcccagccaacaaaaaactctccacaactttgccagagatagaataccgagaaaaagggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgataatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgt

SEQ ID NO: 400668 - DNA, 1563 bp, Homo sapiens
ccgtgctaccccctccccccgggtgctggctccatgtctgtgtgaccggcctcaggggtagagtccaggcccgacgcggggcgggccagcggcggcggcagctgaggtgagagacggcggcggcggcgcgggcacccggccccccagcgggaggatgaagcggcggaacgccgactgcagtaagctccgccgccccctaaagcggaaccggatcaccgagggcatttacggcagtacatttttatacctgaaattcctggtggtgtgggcacttgtcctcctagcagattttgtcctggagttcagatttgaatacctgtggccattctggcttttcatcagaagcgtctatgattccttcagataccagggactggccttctcagtattttttgtttgtgtagcattcacgtcaaatataatatgcctgctgttcatccccatacagtggcttttttttgctgctagcacatatgtatgggttcagtacgtatggcacacagaaaggggagtgtgtttgcctacagtgtctctctggatcctctttgtttatattgaagcagccattagatttaaagatctcaaaaactttcatgtagacctttgtcgtccatttgctgctcactggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgataatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgt

SEQ ID NO: 400669 - DNA, 424 bp, Homo sapiens
aacttaaatggattgcgctgttctttgcacaagagcaaaaacatctgcctggagtgcagcttgtcctagtggctgggacttccctgatacacagctctcccccatctgctgtggagtggtctcactgacatctggggaagcaactggaagaagcttcatccctatttccaaaggttcacagtgactggcagctggtgttgagacagacccgccgccttctgtaggtggactttggtgctggccttggttgtctttttatggacatattgtgaggagtgtgattttcgtcctcctgccccagcagtgtggcagtgcattttttattctttcaagcaggttgtttcatggtgtttcttggcatacgatgggaacagaattaaagatatgcctcttttggggcgtggctttggcaccaaaggctttc

SEQ ID NO: 400670 - DNA, 436 bp, Homo sapiens
atctcttgaaactgttcactattggcacaagtacctataagttaaactaataatgccacattggacagtatatcccataccctaaaccataacgatatatatctaatcaataatcaatgccatatctgtatataaataaaaatttccaacaaacaactttgtatcagcccactctctgtccttctcttgttgtctttacaaatcctcttgtaactgctgtgaatcaaagtgtagattccaggcaaattgaacctttgctcccaggttataatccttaaacttgacccaaataaactgtctacttatattcatgttgtgtcagcttttttttttttatgtagacttatcatttagaatgtgctagagcagcctctatgaggggatccctcctttgtactccatttgctgtaacaccaaacgatgcagaaccaggtgg

SEQ ID NO: 400671 - DNA, 507 bp, Homo sapiens
gggtgggaggcccctgtccccagcagtccgcatcccagccatgagggcaagcaggcaccaaatcacccctaaagggggcagagctcctggcaggattccagttgagcttgggtgtgggcacgtgccctggaatgggttgtgtcctggtgctgccccctagaggccagatggccaggggcaggtcactgagaaacagagcagccatactgaatgggtgcgtctgggctgcaacggctgcggaacatggtggatttgattccagccttcttggatgactttctttacaaggcaaaaatagtatttacagactgggcattgtggctcacgcctgtaatcccagcacttggggaggctgaggcgggcagatcacctgaggtcaggagtttgagacaagcctggccaaaatggtgaaaccccgtctctactgaaaaaaaagaaaaattagccgggtgtggtggcacgtgcctgtaatcccaactactcgggaggctgaggcaggagaatcac

SEQ ID NO: 400672 - DNA, 381 bp, Homo sapiens
tctgagttctagccctgtgccaataactaaatgaccgggtgttcatccgatcatctgagaaacgtttattgagcacctattacgtgcccaatactgtgctagttactctagcggacaatgagatgaactactcaagatgtggcgttgctcttgagtagttccttgtctagttgggactggggcaaggagatgtgatgccagctgggtagggtaaaggctttaagggaacccatggtgggctgggccaagaaaggcttcctggaggaggtgccgcctgagactcaaaacaagtggtgttagcctggagtgtaggggagcgagccttgacgacagagacacgagcaggtacaaagggcagtgaaaaggtacatggccacgtgg

SEQ ID NO: 400673 - DNA, 388 bp, Homo sapiens
caggagccgaacaccacggtggatgtggccatagacacaggccgtgagagctagaagggccttggagccttgggcagccagaccagtaccccacgcctcctcgggaacccccgtccttttcctgcatgcagcagagagccagccccgcagggactcactaagaaatgattgctttccagccacctgtcctcctgcagtccctgccctgcctccgcagtgacccactaccaggctgggcatctgtggcatggaggatgggcagatcccagccctgccacttctgagccacctgtgtgaccttgggcaagtcacttgatcaccctatgcctcaattcccatctgtaaatggagatagtcaagggaaagaaagaaatgtgaaaatgctaag

SEQ ID NO: 400674 - DNA, 815 bp, Homo sapiens
gtgatcctctattccagtgcttagaaatacaggttcattattaactgttggatcatcactaaaacaccctactgtgctctacctaaacttcaaagtgcttaatggcaccaaataattatttcctaattccaatcaaatttattattctatcactatcagttaatatttaacagatagatttttattaagttaatttataccaatatataaatgattaatatccctttaatgttcctgtgatagtttctgttttgaagatgaatgcctgttatcacagagggtatcctagagatatgcaattaatgaagtctgagacaaaactgcagaaagtattatataaagggaattttatcaaaacattttttagtaactcatttatttatttaactgcaactttctatgtatgagactgtgttggaaacaatatacaagacaaatttcgcctatttgtaacttcaatttaaagaatttctccttccaatagaggaaatagatcattaaaatagtttttccttccagataatcttttctggattttcaggttcaggtgagtctcaaaggatgaatatgagccagccatagaaagaaaaatgggaataaggaagtgggaaacatgttttggtcaaaggcattgtacaggtcagagtctcagcaggtagcacacaccatagggatgatcaaggagactttaacagagagaccacttatgaacctacatgcagggtcaagagaaatcagcaagggaaaagctaggagctgtaaccacccttaggcttgaaggggcaagaggacggaacaattacctacactgagca

SEQ ID NO: 400675 - DNA, 225 bp, Homo sapiens
gatgtggcttgattcttccctcccctcttcttcctgtcctgatcatgacatgaaggctggagctgtagtggccatttggtctccatgaggaagaggtcaagacaatcatgaaggctcatgcctgtaatcccaacactttgggaggccgaggtgggatgatcacttgaggccaggtgttggagaccagcctgggcaacatagtgagacctcataactacaaaaaaa

SEQ ID NO: 400676 - DNA, 2794 bp, Homo sapiens
cttcaagattatcaataatcggagatacgtatattttatttgtaaagaaaacatggctgccctattcctacgtggttttgtccaaatagggaactgcaagactgggatatctaagtcaaaagaagcattcattgaagcagtggaaagaaagaagaaagatagactggtgctgtatttcaaaagtggaaaatatagcacttttcggctaagtgataatattcaaaatgtagtccttaaatcctatagaggaaaccaaaatcacctgcatttaactttacaaaataataatggcttgtttattgaaggattatcctccacagatgctgaacaattgaagatattcttggacagagttcatcaaaacgaggttcagccacctgtgagacctggtaagggtgggagtgtcttttctagcacaacacagaaggaaatcaacaaaacttcattccacaaagttgatgagaaatcaagtagcaaatcttttgagatagcaaaaggaagtgggacaggtgtccttcagaggatgcctttgcttacatcaaaattgacacttacttgcggagagttatcagaaaatcagcacaagaagaggaaaagaatgctctcatctagctcagagatgaatgaggaattcttgaaagaaaataattctgtagaatacaagaaatccaaggcagattgttcgaggtgtgtaagctataatcgagagaaacaattgaagttaaaagagttagaagagaataagaaattggaatgtgaatcttcatgcatcatgaacgccactggaaatccttacctagatgacattggtcttctccaagctctcactgagaaaatggttttggtatttctgttacaacaagggtatagtgacggttacacaaagtgggataaattaaaactattttttgaattatttccagagaaaatatgccacggcctccccaatttgggaaacacctgttatatgaatgcagtgttacagtctctactttcaatcccatcgtttgctgatgatttacttaatcagagtttcccatggggtaaaattccccttaatgctcttaccatgtgcttggcacggctacttttttttaaagatacctataatatagaaatcaaggagatgttactcttgaatcttaaaaaggccatttcagcagctgcagagatattccatggcaatgcacagaacgatgctcatgagtttttagctcactgtttagatcaactgaaagataacatggaaaaactcaacacaatttggaagcctaaaagtgaatttggggaagataattttcctaaacaggtttttgctgatgatcctgacaccagtgggttttcttgccctgtcattactaattttgagttagagttgttgcactccattgcttgtaaagcttgtggtcaggttattctcaagacagaactgaataattacctctccatcaaccttccccaaagaataaaagcacatccttcatctattcagtctacttttgatcttttttttggagcagaagagcttgagtataaatgtgcaaaatgtgagcacaagacttccgttggagtgcactcattcagtaggctacctagaatccttattgttcacctcaaacgctatagcttgaatgagttttgtgcattaaagaagaatgaccaggaagtcatcatttccaaatatttaaaggtgtcttctcattgcaatgaaggcaccagaccacctcttcccttgagtgaggatggagaaattacagatttccaattattaaaagttattcgaaagatgacttctggaaacatcagtgtatcatggcctgcaacaaaggaatccaaagatatcctggctccacacattggatcagataaggagtctgaacaaaaaaaaggccagacagtctttaaaggggcaagcagaagacagcagcaaaagtaccttggaaaaaattctaaaccaaatgagctagaatctgtatactcaggagatcgagcattcattgaaaaagaaccgttagctcacttaatgacgtatctggaagatacctcactttgtcagttccacaaagctggaggtaaacctgccagcagcccaggcacacctctctcaaaagttgactttcaaacagtgcccgaaaatccaaaacgaaagaaatatgtgaaaaccagtaagtttgtagcttttgataggattatcaatcctactaaagatttgtatgaagataaaaatatcagaattccagaaagattccaaaaagtgtctgaacagactcagcagtgtgacggtatgagaatctgtgaacaagcccctcagcaggcactgcctcaaagctttccaaagccaggcacccaggggcacacaaagaacctcctaagacctacaaaattaaatctacagaagtctaacaggaattccctacttgcactgggttccaataagaatccaagaaacaaagacattttagataagataaaatctaaagccaaggaaacaaaaagaaatgatgataagggagatcatacctaccggctcattagtgttgtcagccatcttgggaagactctaaagtcaggccattatatctgtgatgcctatgactttgagaaacagatctggttcacttacgatgatatgcgggtgttaggtatccaggaggcccagatgcaggaggataggcgttgcactgggtacatcttcttttacatgcataatgagatctttgaagagatgttgaaaagagaagagaatgcccagcttaatagcaaggaggtagaggagacccttcagaaggaataa

SEQ ID NO: 400677 - DNA, 381 bp, Homo sapiens
gcaatttacttcacttcttttgccttaatttccacatctgtaaactggtacctttctcagaattacagggaggattaattaggttagtattggtaaaagactttaaaaagtgcttggcccataggtttgttactattattatattttgtggcatatattttattttacttttcactatattgtctacattcagtttctattgttttgttatgtatttcttctgataccatggaagatatagtagattgtattttccaaagatggccacgacagtatctctcatttcatttgttcttactatttgacttcaacaatccccttttggaaaggtggagcctgtgtcctctccctttgaaactggactggcatttgtgactgcct

SEQ ID NO: 400678 - DNA, 466 bp, Homo sapiens
aattgaatctgtaaggtctctgtttagaagatctctttttctgaaagcctctttgcctttcattataaaagagcctggtactgctctctgttttaaaaatccagctggaaaattacagagcacaaacatttgcccatcggttcttcatttggagaaaacagaaatatgtcttcaaaatggaggctgacatttaagtatttattcctatcagcgggagctgtagtttgtattttttgcattttacttctgtaaccacatataatatatcttggcttctgcgtggtgtaactgtaaaacaccatctttattttatgtcattttgtgattgttgttcaaatcctccaatgatctgtttctgagcccctcagaatctctaaaaaaatcaaggtatccttccttttctttttggctctattaaattgaaacataaatggttgattctaataataaaaattggctcataaat

SEQ ID NO: 400679 - DNA, 729 bp, Homo sapiens
acgcaatttagctaagtataaaatattaatgcacaaacatggctttaaatatagccagagaatctggcaggaggaagccacccaacagccccctctacacatcactctctcaaatcaaaggctgggtgaataatgaacatacccatttccaggtcgaaagtacaggtggatcgtgacaggccatctcaaatcctgggaagggagggctgctaagaatgacagccatttcagaaaacaggcctgggttagcagttttattcagacagggtttggcctcctaacctctcctgctttccctggactctctttgaaaaagggtgactatattctttttttttttttttttttgaaacagagtctcactctgtcccccaggctggagtgcagtggcgcaatattggcccactgcaacctccacctcccagattcaagcgattcccctgcctcagcctcccgagtagctgcgattacaggcacgtgccaccacaaccagctatttttttgtatttttagtagagacggcgttttgccatgttggccaggctggtctcaaactcctggcctcaagtgatctgcccacctgggcctcccaaagttctgggattacaggcgtgagccatggtgcctggccaggaccagtatattcttgatgctcagggatgtggtttgtacccagggcaacatagaacagggttacaagcatgggctcaggtgtcagattacctaggt

SEQ ID NO: 400680 - DNA, 479 bp, Homo sapiens
tctcatccagactagagtatcaataattagcaccatttgaatgtttatgtcaaataatttgtggcccttaagacagagttggtggatgtttccttgtgttcaatacatgaaaaggctttcaaatctttaattagtgtgtcttttatttccattatttgaagatgaaaatgattcagtcaaaaaaatttcagctccaatattaagattatcttttgaggaagcatataaaaataaaaacaatgacaatatccaaccccatccaccccttccccagtagaagttgatatctggctagaatgagcattaataaataacctagagaaatacagtattgtacagttttatattttcaactttttattaaaatttttaccacaagtgaataatttttgttaaaatctaactttttgtactctgtattggatatgatttgcttgcctaattaaagtctacctgctgattatactagaaaaaaaaaa

SEQ ID NO: 400681 - DNA, 372 bp, Homo sapiens
cctcccacccttaatgaaattctgtttatgtgcacaagaaacttcaaaataccaccatttgatctccctgaaaggtgaagaaaagggtaaccacaaagaaccaaccagaataaaccacaggggacttaagtagtaacaaagaatgcaaggaagacccaaatctagcccaggatgatttctgacacaaatgaaagccgttatgtcttcaatcactgccagtaggagaatgttagacttggctgaagactttccataacaaagtcttgtgcgtgggcctcttgagagtgtttcctatatgtcctggggcactataaatacaggctgtggtaggccagacccaagcaaagggggctttctcttgtcaccctacct

SEQ ID NO: 400682 - DNA, 591 bp, Homo sapiens
gccgtgtctccgggctggggtgctgctggtgcagcagatgaggcacctgaaagcactccgaggaatggccaagccctcatcgcacagccagagctggtcacagtgctgctctgcacaccagcctctagtcataaaaataaggaacacactaagaatcacacccctgtgatcccacatcagatgtctcctcccatcctgagttattaataattttattaagaatatgctttcaacacgcttgtatttatatatgtacttaacaagaaatcaccaagactgcagcgggcagttcctcttccctttccttttcattgcccagagaaagggagacagcagtggggtctccttccgccctcaggcacagcttgctttgagacttgcagtatcacaattagtgttctcttgcagcttggacttaaccagcttaaattaccatctgactgaagggtgcgagtgctgggtctgcatgtgtttctttccatcaggggaaagatttgccagtgcatgtttgaacatctgcaagtttgggtttattttggctccaaatctgtatgcaaactgttggtcataaagagttagaagttcacagcg

SEQ ID NO: 400683 - DNA, 376 bp, Homo sapiens
ttgaaccaaaagtttaccggggagtgtctccctgcagtctacattttaaaccgatctctcgggtgattcttacccacctacaaatttgagaatctctgcgtttatcagttttgcacaggctggtttcctccggaatttctgctctagtgtctctgaacatttaagacccatctcataggtcatctgtgatgctttcaaagttgactagctcctccctatgcctgtgttcccacagtaagtttgcatcttactctgtaagtatcggggccttccccgacaagactgtgagctctttgagagccgagatcagttttgatggatttctgcacctccagagaaaagtagacacagtacacatcaattaataaagaaatct

SEQ ID NO: 400684 - DNA, 235 bp, Homo sapiens
ctttctggacaacccaagataacctccccatctcacaatccttacatcatagattccaggatcaggaagggggcacttcggagagtgccaaccttagccaaccatagccactgaggactggggggataagactggcaagatccaatccatatgttggcaaatggatttctggtgctcagaaatgaccaatctttaggaagcaacgagtttctgaaaacaaaacaacaacaacaaa

SEQ ID NO: 400685 - DNA, 428 bp, Homo sapiens
caagattgacaaaagactggccctaatggagtttacagttctcagggagatacagtcaacaccatcataactggtttgggggaacaggggagatgaactggaccattctaaaaggaggcaagaggtgcatctgaaattggaaactggagaaaccaggggagacagacctgttgatctggaaggcatagaacagaaagaaccagagaatagtcagggactgacaatgaggttgtgattgttgacagccggaccaggccaggaaatgaagaaggtaaggagagaagcgtactgtctaacacccctcgaatgcacagttgctagggccagtaaagatcatcgggctactcatctctcaatttaggtaatgtaaatgatgcatcttattgacaatccatatccttaagaaattgtgaaatgagtcttttact

SEQ ID NO: 400686 - DNA, 528 bp, Homo sapiens
tgctagctgggagtcctgagagcatatccattagtggagcagaagttcaaaactctgcctattttcaatacccctttcttacactaaacaaaagccttaagccattgtggaagaggcagagtaccccctcctccaacctcaaagcctagtccatgatggactgcttctggtgatgggatagggacaaatgctgcctacccctggggagtgggcaggaaaccctgttggactcaggaccctgcactgatataagacagagatctgttactgccagggtagaggcagagacccctttagcaccacctgcagttacaagacatagttttgttagtggtgggggacaggaacaccaagaaagtcccacccccaaggctcagctgcagcaaaaaatttgtcttatgctgagttggtaccaggagactcaaaaggtcccccaacccccactatgaacttaacactgagaaaccttcaagatcaatctaccactgggaaagagagacaacctactatcctacaggcgtgcaggac

SEQ ID NO: 400687 - DNA, 678 bp, Homo sapiens
  misc_feature (171)..(171): n is a, c, g, or t
gattacggtataagatcactgtcttcaagcagtgcgaggcaacgccacctccccggctaaaatcgacatcacctttgcgtctagtaccgcgacggtacccccggactcaggcttccagcaccaaacggacacaacaacgccatttttgcaagaactacgcatgcatttccncagtaagcgcaagtgagcaactttcgcgtttgatccttaagcccacacattctacactggaaggctttgacttgggacatcgaccaggcaagagtagggcacacatgcggtgggacaccgctattacagcatgattgaatgctacacaaacaaaagatgctcttgtggcgatgtatggcctgtccctgttgtccagctaacaaaattaagggggcagatgaacacaacacaaattcaaacacaacagccgatccagcagttggcatttccactcagacttaccttaagaacaagtaatcatattacacataaaccttaaaaatggatatgtaccagcttcatttctcactgtttcgttagatgaaagtttcagatgctgggccaagcgcagtggctcacgcctgtaatcccagcacttttggaggccaaggcgggcagatcacaaggtcaggagttcaagaccagcctggccaacatggtgaaaccccgtctccactaaaaatacaa

SEQ ID NO: 400688 - DNA, 834 bp, Homo sapiens
gaggactgtcgaggaggagtgatgagaagagggggtgccctgcaccccccgagaccacgggccacgctgccacttgccaggcgccccccttcctcccaggcgaggggcaggtgttccacactgattctcgtgactttaaggaccagggatttgaagaggtattagctcttcccaggaagggaggaagtttctggaagagaagggaaagacggcagacgctgcgctgggaccagcagagcctgaggagctgtgggaagctgacagagcccagccaaaggagcgggaaggagccgcagccccaggctggcactgtgttctgaaagatttgaactcaagctgctttttacggaagaggggccacttcagagggcaccccagaatttggttgagctcttctactctggatgccccctgctctgaggagcctgccactgagaaccaaagaagataagaggacagatactttttcttcaagcacagagctggtgggttggagtcaggcatctgcacccctagtggctgtctggtgaggaatttcttgtttcttcccagcttgcggcttcagtgcttgatggggctgcctgttggtggatcagtttttgcagtgcctggtaggagtggagagccgtgggaagaggtcctgcggcgcccaagcctgggttcacccagatagtcttccagtggagagagagagaagcaaaaaaaaaaaaaaaaaaattgggggccgcgcgaaagtttaaacactggggcgggccaggagaaggaagtccgggacggccgagggtgtcccaaacgggccgggggaccgtggcttctaggccccccccgcggggt

SEQ ID NO: 400689 - DNA, 544 bp, Homo sapiens
cctggcttgaacttaggcatcctagtgcctgcgctgctggggctcaaagggaacctggaaatgaccctggcatcaaggctttccactgcagccaacattggacacatggacacacccaaggagctctggcggatgatcactgagaaccaaagaagataagaggacagatactttttcttcaagcacagagctggtgggttggagtcaggcatctgcacccctagtggctgtctggtgaggaatttcttgtttcttcccagcttgcggcttcagtgcttgatggggctgcctgttggtggatcagtttttgcagtgcctggtaggagtggagagccgtgggaagaggtcctgcggcgcccaagcctgggttcaccccaagactaagttctttcccaagttagagaagaagagagaaagcaaaaagaagagaggaaagttctcccttcccctcctccgtgcctgtcatgtcctctaagccagagccgaaggacgtccaccaactgaacgggactggcccttctgcctctccctgctcttcagatgg

SEQ ID NO: 400690 - DNA, 836 bp, Homo sapiens
gaggactgtcgaggaggagtgatgagaagagggggtgccctgcaccccccgagaccacgggccacgctgccacttgccaggcgccccccttcctcccaggcgaggggcaggtgttccacactgattctcgtgactttaaggaccagggatttgaagaggtattagctcttcccaggaagggaggaagtttctggaagagaagggaaagacggcagacgctgcgctgggaccagcagagcctgaggagctgtgggaagctgacagagcccagccaaaggagcgggaaggagccgcagccccaggctggcactgtgttctgaaagatttgaactcaagctgctttttacggaagaggggccacttcagagggcaccccagaatttggttgagctcttctactctggatgccccctgctctgaggagcctgccactgagaaccaaagaagataagaggacagatactttttcttcaagcacagagctggtgggttggagtcaggcatctgcacccctagtggctgtctggtgaggaatttcttgtttcttcccagcttgcggcttcagtgcttgatggggctgcctgttggtggatcagtttttgcagtgcctggtaggagtggagagccgtgggaagaggtcctgcggcgcccaagcctgggttcaccccaagactaagttctttcccaagttagagaagaagagagaaagcaaaaagaagagaggaaagttctcccttcccctcctccgtgcctgtcatgtcctctaagccagagccgaaggacgtccaccaactgaacgggactggcccttctgcctctccctgctcttcagatgg

SEQ ID NO: 400691 - DNA, 945 bp, Homo sapiens
ccgtggccctgcgccaccttccccgctcaaggagacctccttttccatcgggctgcaagtactgtttccattcctcctggcaggctttgggaccgtggctgctggcatggtgttggacatcgtgcagcactgggaagtcttccagaaggtgacagaggtcttcatcctagtgcctgcgctgctggggctcaaagggaacctggaaatgaccctggcatcaaggctttccactgcagccaacattggacacatggacacacccaaggagctctggcggatgatcactgggaacatggccctcatccaggtgcaggccacggtggtgggcttcctggcgtccatcgcagccgtcgtctttggctggatccctgatggccacttcagtattccgcacgccttcctgctctgtgctagcagcgtggccacagccttcattgcctccctggtactgggtaagaaagggagggcatagaggagtaaggagtgccgccccagagaacactgcacctggcacttccactctctctttttgtttgttgagactcctttatctcttctcaccctgcctgcccctcctcccacttgctcaccaggtatgatcatgattggagtcatcattggctctcgcaagattgggatcaacccagacaatgtggccacacccattgctgccagcctgggcgacctcatcaccttggcgctgctctcaggcatcagctggggactctacctggaactgagtgagccaccaagagtgtggcttcttggagtcctgggtggggttgggagagatggtagtagtttgcaaatgtgcaagagtttcttctgtgttcttaaactatttggtttgaacacaggttgtaataattcctgatcttagagatttgaagctaagtactgatctcaaattcaagcaggcatcaggggcaggggaaaagtatcaga

SEQ ID NO: 400692 - DNA, 1753 bp, Homo sapiens
  misc_feature (989)..(989): n is a, c, g, or t
  misc_feature (1335)..(1335): n is a, c, g, or t
  misc_feature (1632)..(1632): n is a, c, g, or t
gtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtggtcccagcactttgggaggccgaggcgggtggatcgcctgaggtcaggagttcgagtccagactggacaacgtggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaaaaaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcgggaaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattntaggcgtgagccaccatacttggccatatcattatattttcaaatggtttcttgttttttcgtttttcttttaaatgtaatctgacagcgtcttttaattaatgtgttttggaccattcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctancatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgccncagctactcagaaggttaagtcaagataatcacttgaatccgggagttggatattgcagtgagccgagatcacgccactgcaccccagcctgggaagcagagcaagactccatctcaaaag

SEQ ID NO: 400693 - DNA, 709 bp, Homo sapiens
  misc_feature (291)..(291): n is a, c, g, or t
  misc_feature (588)..(588): n is a, c, g, or t
ttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctancatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgccncagctactcagaaggttaagtcaagataatcacttgaatccgggagttggatattgcagtgagccgagatcacgccactgcaccccagcctgggaagcagagcaagactccatctcaaaag

SEQ ID NO: 400694 - DNA, 101 bp, Homo sapiens
tgttgggattactggcgtgaggcatcgtgcccagcaagctactgtcttttctttgaccctttccagtttttgaagataaagcaggaaataatcttctctga

SEQ ID NO: 400695 - DNA, 379 bp, Homo sapiens
agccctggcattgcttgttccccgactgtggtgctgtgtcctgggcactctgaggattcccttcttcttgaagggtatcagagcccggtggggtcagccacctgtgcggaatcctctccagacaagtcagctctggtgcagaggcggctcgtggcttgtggaacatcagaagacagaggagcctcctggggactgagctccagcaccaacaaggccgggcccctcccagcaggttcccacatggccttctcatcaagggctccttggaggaaacccagctgtgtgccgaccacagagaacctcgctcaagctaggaaagttcttggactgcttaataaaatcgcaatgtttgttaataaaatcatactttagttgcccc

SEQ ID NO: 400696 - DNA, 343 bp, Homo sapiens
tcatcccaaggggccacattttattgggagaacctcagaagcccaaggtactgctcagttctgaggcctgagacccaagctgggtgcacctgggctggaacagtcacatccccagcccatgactagggttacgtattttaaaggacaccccaatttctcagaagcagcacctgacaagaccatgggtgtaaagacaggaaggatgttccaggcagctcccggggagggtctgactacctgggtcaaccacaagctagctccatgggaaccaatggcagtgaccagcgggcaccagctcctgacacagaaatgctcttcttccccctcagtaccccggaggcca

SEQ ID NO: 400697 - DNA, 256 bp, Homo sapiens
gaactcctccaaacactttctgaactccctacccctcagagcccctttacaagccacacgggatgtagatctcagccccaaagcattgcctgttttcatcatcgacttcattcacagacatagttctaaatgactttcagctatttctagaaattagacacatcttcctaagcgaaggtttaccatgtttaaggttccatgaaagaatgtgccctaagttgttgcccagcccctggctgagaagaaacgggcgtgt

SEQ ID NO: 400698 - DNA, 474 bp, Homo sapiens
caaaccaacaacaaaacacaagaacttcccctgtcatatctagagaaaatgactttggggcacagtttaaaatgaatcacccacatacataagtggcgtggtaacaacacagaagatgaactgaaaaattaaaagtcatcagaatatacagattcttgcccccgatatggtgtagtgagtagaaaaatccatataagaaatgaaaacgaacctggcaaataccctgtttctaaatgcatgccacatcacacaaaggaaattcacacaaaggaaattcaaggaatcatgaaacattagaacaaggaagccccagtgaggtttacagtgtgcgtttttccctgccacctacacattccacagccaagtatcacagcattgtctcaatgactaggcaacacgggctatagatgacacataaatgtataaagtaccaccagaatacctggtggaaagtattcttttatgatgatcagt

SEQ ID NO: 400699 - DNA, 171 bp, Homo sapiens
cacagatccaatagaggaaaaatactgtcttcaggcagataggggatgtgccactggggccgagatgacgagtttcgtgaaaaacagagttcaaaagaggaggctcttgagtgtaaagataatttgaggggaaaagaaaaagatagaatgtgactggaaggaacggaatag

SEQ ID NO: 400700 - DNA, 222 bp, Homo sapiens
accactggtctgtttggccctccgggtcccctctctagctggcctcccatcttcccctgctgagccaggttggtttcggaaatgcccttacagcagcaggcaaagtgaagcctagagctaggaaaggcgctcacagtacctctcagatggtttcaaaacccctgagggcaaaagaagagctgctctatgaagtccagatagtcctaaaactccaaaaatctc

SEQ ID NO: 400701 - DNA, 646 bp, Homo sapiens
acccatgtttaaaactttaacataagtagcataatgacaccattaaaaaaggaaagagaagcttgagggaaagaacatcctcagatgacgcggcttcagaatgcacgcagcacacacggaaagcaagagatgttcaactgtgtattaaacacaacaagccagcctgcaacgtcagcctgcactgtggcttccaaaagattatcttcatctcactgccatattccacgtgccttacagcccaggagtatatcgaggaagaccctgctttctgatcacacatctttttcattagacttggcttggtggactcttgagttttccatgaaccaagctctccctgaccgataagagcattcaagagattatagcacaggcctgggaggcactagaagtgaccagggctgaggtattccaagctgtgctggggagtcagcccctggcacccaccttgactcttgaccccggcacggactaagtgtgatcttggctttccccagtgttcttgcttgtacagtgcttggaactgtgcccggcctacagcgagccccatgcaaatgtttctacatgccccatggaggactctatgcatctggggttagatccacatgggccactttatccactgactgtgacgcctgggtgggca

SEQ ID NO: 400702 - DNA, 414 bp, Homo sapiens
ttaataaaaaggaagttttttcgttttagcaaaaacaaaaaacaacaaaacccattttagcaaaaacgaacaacaacaaaacccatttacctaatacgacagtgagaaccaactcattgtgtaagattatttattaaaaggaactaaaacatttaaggcatcttaaaaatgaaaattatggccgaaagtattctactcctttcgaaaatattccaagtttttgtcatttcaaaacacaaaacttcctgatcaaatgtgtaagtcattaaaaggtctggcttttaccttatatatacaaggactaaaacatctgatttactctcttacccagatttttacatgtaggtatgcatgtatatgaataatgctcgtgcatataaatgtactgtatgcatacttacatcatgcatacat

SEQ ID NO: 400703 - DNA, 678 bp, Homo sapiens
gttttgccaaacccaatcagaaggactgcctggactctgtacatgagcctgttgtgacctgattctcatgtattctcgacacaatgctgaaggtccaaagccctggcacttctagggagcaaatacctccagagttgagtaaacctgaatcaggaacactttctctgactgaattctacctcaacaatatgcatattcaaaaaagaaaaggtaacatccttggaaaatatgtgctgggaactgccatattcaaaatacttctaaaataaatggagagtttttttttttttttaaaccaggaaaaaaactcttgtgaagaattagtttctaagtttttggtttctaagtagtttctaagttttctttgtattttattgatctcaaatgttgttgggttttatacatcacgtaacttttgatgttacttacagaatactctaattctatcattagatgtgtttatttctgaaaagtgagtgattgttgaatagaatcccattagcaacattaatgttacaatttaaagacaataatttcttgtagaactatgacgaggatacaagttttgcaatgttaaacatttttggaggtgtacttcccttgagtgggcacagttttagtcattttgatctatttttaagcttcagtttgaaaaagtcatacctcatttgtccttat

SEQ ID NO: 400704 - DNA, 410 bp, Homo sapiens
agagatcctaccgtctcagtctcccgagtagctgggcctacaggcatgtaccaccatgcctggctaattttataatttttttggtagagatgagttcttgctatgttgcccagaatggtcttcaactcctggcctcaagcgatcttcctacctcagcctcctgaagtgctgggattataggcatgagctaccaagcctagcctatatggtgtatttcatcaaacctaagacactgttgatcctaagatgcacccaggttttagagatgttaaaatgcacctccacctccacaaaaaagtatgctttttagaaatgaaaataaccactacctactcagaatctttagataaaaaatgttgtcaggccacaagcagaggggcttccccgcctctgaccttcttcacacgggg

SEQ ID NO: 400705 - DNA, 392 bp, Homo sapiens
gatagggtttctccatgttggtcaggctggtcttgaactcccaatctcaggtgatccgcctgcctcggcctcccaaggtgctgggattacaggtgtgagccaccacgcctggctgacctcccactttctataggaaggattcacttcacttccctgagctttaagttccttgtcagtatatgtgaggccatgccagagcgcactgtagtgctatgcacacctaagggactggttagtagataccatttcgtggcagcaaacagaagccgaggataagggggctctcttacaagtgaattcaaaatttgggttaatagtaaatgtcagttttttgtttttttgttttgaggcaaagtcttcgtcacccaggctggagtgcagtggcaccatct

SEQ ID NO: 400706 - DNA, 219 bp, Homo sapiens
agtgacaactactttaaaaatggcacagaatggaaaagataggttaacaaagtagcattttagaaaattgaacacttccccacttatgagtaaattttgttgtaaatactttataaaatgtgtattgaaatgttgctttaacctaacttgaaaaacattgatgaaaaatgtaacgacaaaggtcaacagtttcataaagcctttagccaagttttcata

SEQ ID NO: 400707 - DNA, 497 bp, Homo sapiens
gcacatgcctataatcccagctactcaggaggctgaggtaggagaattgcttgaacccgggaggcagaggtttcagtgagccaagatcgtgccattacactctagcctgggcaacaagagtgaaactctgtctcaaaaaaaaagaaagaaagtcactgaacttcagaggaagaggccagaattcgagctttgccactaactggtagatggccatggacaagctgaataacctctctgggcctcagtttccatatctgcaaaaatcagccagcggtaccggatgctcattaggtccctttccagttccacattcttgtactaatgtaatttcctgctcatgaaaaacatctactactagaaaagaacttccatgtttggtgttcaatataatgggatgttgcccttatttcaaaagtggagtagctggaaagatcaagaaaaaatataaaattaggaaacacatctaataaatccccaaagacttgttaaatgaccac

SEQ ID NO: 400708 - DNA, 379 bp, Homo sapiens
ggctctctaaggagattcttctggcaaaagaccttggctcagactttcaggtaaggtgcctcatgcacagatcctattatttatttttttcctttgttttgttttgtttttcttgagatagggtctctccccgctggccaggctgaagtgcagtggtgcaatctcagttcactgcagcctcgatatcctgggctctagccattctccccccctcactctcctgagtacctgggactacaagtgagcaccaccacacccagctaatttttatttattttttattttttttgagacggagtctcgctctgtcacccaggctggaatgcagtggcgcaatctcggctcactgtaacctccaactcccaggttcaagcgattc

SEQ ID NO: 400709 - DNA, 1622 bp, Homo sapiens
cggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcagccacctgacttcagggacctgccggaatgggagcccaggatccgagaggctttccgcactggtgacttggactctaagcccgaccccagccggagcttcaggccttaccgagctgaagacaatgattcctatgcctctgagatcaaggagctgcagctggtgctggctgaggcccacgacagcctccggggcttgcaagagcagctctcccaggagcggcagctacgaaaggaggaggccgacaatttcaaccagaaaatggtccagctgaaggaggaccagcagagggcgctcctgaggcgggagtttgagctgcagagtctgagcctccagcggaggctggagcagaaattctggagccaggagaagaacatgctggtgcaggagtcccagcaattcaagcacaacttcctgctgctcttcatgaagctcaggtggttcctcaagcgctggcggcagggcaaggttttgcccagcgaaggggatgacttcctcgaggtgaacagcatgaaggagctgtacttgctgatggaggaagaggagataaacgctcagcattctgataacaaggcctgcacgggggacagctggacccagaacacgcccaatgagtacatcaagacactggccgacatgaaggtgacgctgaaggagctgtgctggctgctccgggatgaacgccgtggtctgacggagcttcagcaacagtttgccaaggccaaggctacctgggagacagagcgggcagagctcaagggccatacctcccagatggagctgaagacagggaagggggccggggagcgggcagggcccgactggaaggcagccctacagcgggagcgtgaggagcagcagcacctcctagctgagtcctacagcgctgtcatggagctgactcggcagctgcagatcagtgagcgcaactggagccaggaaaagctgcagctggtggagcggctgcagggtgagaagcagcaggtggagcagcaggtgaaggagctgcagaaccgcctaagccaggtg

SEQ ID NO: 400710 - DNA, 351 bp, Homo sapiens
ctcatcataattaattactcgttcctctctgttctcctagcgtttcttcacacatctgcttacccatttttgtaagtcctcctaacacaatattataaggcactagatgctcaatcaatatttattagtttaaagctaccagctttagggggactcggttttaaatagatgagaagtgataaaacacctggagatagtactgtcagctgagataacatgtcatagaaccagctgctcagcataattgaaatttcattcggattatatgggcctactttacacccatcttactatggtaaatgagatcatgctcattaagcattaggacactacttggttagcgcatctagg

SEQ ID NO: 400711 - DNA, 282 bp, Homo sapiens
tgtgtgagaagctcgggcagggctctccgggccattttctcactggtcctgaggcctgctggctgtggcccgagggcagggacggcatggtggcctgggggaaccgtctctgcaggcacttctcacctcccggctccagtgaattacaggccctgtggggcttgatgccgtggatggaagttttgtagaaggccatgtttgtgtcttctgtgaagtatgaaaggtgccagtttgaaaaccagagaaaaagaaagcgtggattaaaatgcagtccccgtttta

SEQ ID NO: 400712 - DNA, 289 bp, Homo sapiens
tgggaattgattatatcagtatttactcacacttttatagatagatagatagatagatagatagatacagaaagaaatataaatataactgtgttacatatatatgtctatacagattccctcagctgtgttcactcatagagcctgagaatagagcctggagcagcatcttgttattctggaaaggaaggatgtgccaaaagccaggctaaaggggctcccactggccaaatctgtacattttgaacaacaaaataaatagtgatagtaatagatttataattctttg

SEQ ID NO: 400713 - DNA, 398 bp, Homo sapiens
ctaaggtggtttcataggcacagctgggttgggagcagggatggatgaagtggtgaggaaggaccacagaaaggccctggtcctgctccaaggccatgatcccggagccctatggaaaccatggccctgcacctttcatgcctggcattttactgtaagggaagtttggggtcaccactatttgtgagtcatctaggccacaatgtacctacaccttaatccctatcaaagatggtggaggcccttgggcagggccagagctctgccctggtgctcaggacgaccaggtgcctaaccttggtatgggccttcctgccactttcatccaagttttgaactgcgtcccaggagggtgactgtcaggatgcccagtgattagtcgtgggagcagagggggc

SEQ ID NO: 400714 - DNA, 547 bp, Homo sapiens
tgagatggaatctggctctgtcacccaggctggagtgcagtggcatgatctcagttcactgcaacctctgtctcctggattcaagtgattcttctacctcagcctcccaagtagctgtgactacaggcgcgcaccaccatgcccggctaatttttgtatttttatttttattttatttatttattttgagatggagtctcactctgtcgcccaggctggagtgcagtggcacgatctcggctcaccacaacctccgcctcccaggttcaagtgattctcccgcctcagcctcctgagtagctgggactacaggcgcttgccaccatgcccagctaattttttgtatttttagtagagacacttcaccacatttcactatgttggccaggctcgtctcaaactcctgaccttgttatgtgcccagcccaggatgagtttcttatagtcagttaggagccaagacttccagatgctggctgaatggcttctggaaacacttcttttttgactagggcttaaccacccattattcaggtacaaactctta

SEQ ID NO: 400715 - DNA, 548 bp, Homo sapiens
tgcactaatactgtaaaaaatatgaccctggacagcacagatctgatgttcatgaaccactacactatggtgggggaccgtggctcatgcctgtaggctgaggcaggccaatcacttgcgttcaggagtttcatggcgaaactcttgtctttacaaaaaaaatacaaaaaaagttagccagggatagtggcatgcacctgtggtcccagctactcaggaggctgagatgggaggatctcttaagcctggaagttcaaggctttagcttctacaaaaaaacaaaagcaggctggacgcagtggctcacacctgtaatcccaacgctttgggaggctgaaggggggggatcacgtaaggtcaggagttcaagaccagcctgaccaacatggagaaaccccatctctaattaaaaaaaatacaaaaatcagccggacatggtggcacatgcctgtagtcccatctactcgggaggctggggcaggaaaattgcttgaacccaggagacggaggtcacagtgagccaagcctgggaaacagagcaagatgcc

SEQ ID NO: 400716 - DNA, 592 bp, Homo sapiens
gagacggagtcttggtctgttgcccaggctggagtgcagtggcacgatcttggctcactgcaacctccgcctcccaggttcaggggattctcctgcctcagccttctgagtaatgggattacaggtgcgggccagcacacctggctaatttttgtatttttagtagagacagggtttcaccactatggtcaggctggtctcctgacctcgtgacccacttgcctcagcctcccacaagtgctgggattatatgcatgagccactgcacctggctgaaaaccacaacatcttctaaagataaggctttagcttctacaaaaaaacaaaagcaggctggacgcagtggctcacacctgtaatcccaacgctttgggaggctgaaggggggggatcacgtaaggtcaggagttcaagaccagcctgaccaacatggagaaaccccatctctaattaaaaaaaatacaaaaatcagccggacatggtggcacatgcctgtagtcccatctactcgggaggctggggcaggaaaattgcttgaacccaggagacggaggtcacagtgagccaagcctgggaaacagagcaagatgcc

SEQ ID NO: 400717 - DNA, 521 bp, Homo sapiens
agcaggaggatggaaataataaagatttcagcagagataaatgaaatagagaaaaataatcatcatagaaatcaaaagttggttctttgaaaagatcaacaaaattgacaatctattagctagactgagtgtttaaaaaaaaagggaaaaggcaaataactaaaatcagaaatgaacaatgggactttgctgctgaccttatagaagttaaaaggattgataatactataaacaactgcatatcaacaaattagacaatctaggccaggcacagtggctcacacctgtaatcccaacactttgagaggccaaagcgtgaagaatgcttgaggccaggagtttgagatcagcctaggcaacacagtgagtccttgtctctacaaaaaaattagccatgtgtggtggcatgcacccgtagtcctagctactcaggaggcttaagcccaggagttcaaggctgcagtgagccatgattgtgccactgcactccagcctgtgtggtagagcaagaccctgtctca

SEQ ID NO: 400718 - DNA, 217 bp, Homo sapiens
ctgtaaccatctccacaattaggattccagcagtaacatcaccctaaaaaattctgttatccctttgtagtaacccccttcccccatataacatctggcaaccactcttctccatgactacacttttgtctttttgaaaatgtcacacagatggaatcatatagcatgtaagctttcgatacgggcttctttcactcataaatgtctttgagactta

SEQ ID NO: 400719 - DNA, 233 bp, Homo sapiens
  misc_feature (180)..(180): n is a, c, g, or t
cccaaagcaaataaatttttattaagtccagtaccttgctttttaaaacaacacgatagcttacaaaagaaatgaagctttagtacacactcttggaaataccttttcagatgatggtgaaaataataaaactgcaatgaaaataatgacacccataataggacacactgggtgcatacnatattctcggcactaggctgagcaacacagtgggtattttacatacacattcc

SEQ ID NO: 400720 - DNA, 423 bp, Homo sapiens
cataagaagttataaaagtattaattttgggaactgataaatgtccatgaaatcttcacaatttatgttcagagattgcagtaaagacaggtgtaagaaattataaaactattaattttgggaactgatatgtgtccatattaaagtgaaatcttcacaatttatgttcctctgctgtgactccagccagtccctctgtttggggtccctgacttcctgcaacacattgtgtgacttcttttactctctactgtctctttgaatgcaacactacaacctcctgtacccttagaacccctaacaaagtgtggcctcttatcaattttatgtcactcttttatatttactaatattatatacattgtattttctcaggacttattttcctggcaagggtataataaacaggcatttttaacaact

SEQ ID NO: 400721 - DNA, 401 bp, Homo sapiens
cattaagttacatcagaagttattattagagtgatgtttaatctcaccctaatgtaacttctgattagcaagcttccattctctctgccaaatataactcatgttaacgtagaaaagtgttatcattagttaccagagcaaatccagtgtactggattgtgaatgcatagtctttctaattaggaaaatgagagtgtgtattgtcttcttaatttacatttataaaatcctcataaaatacagttaagtcagggtcttttaaaagagaagaattcaactgaaacctgtcattctctagccgggcatggtggctcatgcctgtaattccagcacttggggaggctgaggcaggtggatcacttaaggccagtctggccaacatggtgaaactccatctctac

SEQ ID NO: 400722 - DNA, 384 bp, Homo sapiens
ctgagctcagttgtccagttgggaaagagatcaaattaaaagctacctgtgctaccttagcatcattctttatcttcctctaactaacacaaaatcatctttaagcttaaactttccatcactctctgtgctttgagatgtaaatttgccactgttttctctaaaattccataagggcttcaatcatgtgaaacagataaactttactttttccagttacacaaaagcacagtttgaatcccgtgttgtttgttttgttttgagatggagtttcgctcttgttgcccaggctggagtgcaatggcttgatcttggctcactcaacctctgcctcccgggttcaggcaattctcctgtctcagcctcctgagtagctggaattac

SEQ ID NO: 400723 - DNA, 395 bp, Homo sapiens
cacatctgccactcatcaacatatatcagttctggatgcttggataattcctctcattccaacaagttagcaaagcaaaggagatgccaccagaatccagaattgtttaccaaactctaattaaatgcacagctctacagagtattgccaaacagactggacacataatattaatgcagaaacaagagttacattttgaaaatgccatcaggcagaacagaaaaaaagaaagctgcatattggtgacatctgtgcgcatgtgaggaaatccacacaagaaggtaaagatatacaggctctactcaatagttgtctaaactaggaaaggtaccctggactgccattctacgcagttgagagaacactggatgtgttgttgactgctgtagctcaat

SEQ ID NO: 400724 - DNA, 921 bp, Homo sapiens
aattgaggaaggaaacaaagcttaaggcagtgattgataggttatttcttggacacagctgaacgtatactgtgcgcctgcaactttccggtggtttcggaccggacttcagtgaagccagtgaagtcggtcgacttgcagaacttcctttcagaggggcgtacacagcaccgcggccgtgtgcctgtgatctccttctgagtttgaaaaagaagatcctagacaccgagccaaatatgtttgcataaaccgggagacttgtggctctattttgtaacagcttggcgcagggcagctggtttggagatgtctctgttcttcccttggtgggggtgccggaaaaaatgtgctgcctgggcgatcgaggttggggcaaaagcgttgcaaaggaaaaggtgggaggactctactttcacatttcccaaaagagttttaccataagactatttctggattgttctaacgtgaggatattgggagcattttgaaaatactggaggaaaagctgtcactgggcgatttaaatccgggacagattcactctgtcatccaagctggagtgcagtgagccgagatcacgctagtgcactctagcctgggtgacagagcgaaactctgtctaaaaaaaagaagttatttttatcaatatatattaacatgcaatggatttattattattattattttatttatttattttttacttgagacagagtcttggctctgccacccaggcctggagtgcaatggtacaatcatggctccactgcaactccggctcccgggtccggtgattctcctgccttagtctccgaagtactgggatttgcgggccgttcaccatgcccgtaattttgtattttggaccgatggggttcacctgttggccggtggtccgaacccggacctcaggtgttcccc

SEQ ID NO: 400725 - DNA, 1212 bp, Homo sapiens
aattgaggaaggaaacaaagcttaaggcagtgattgataggttatttcttggacacagctgaacgtatactgtgcgcctgcaactttccggtggtttcggaccggacttcagtgaagccagtgaagtcggtcgacttgcagaacttcctttcagaggggcgtacacagcaccgcggccgtgtgcctgtgatctccttctgagtttgaaaaagaagatcctagacaccgagccaaatatgtttgcataaaccgggagacttgtggctctattttgtaacagcttggcgcagggcagctggtttggagatgtctctgttcttcccttggtgggggtgccggaaaaaatgtgctgcctgggcgatcgaggttggggcaaaagcgttgcaaaggaaaaggtgggaggactctactttcacatttcccaaaagagttttaccataagactatttctggattgttctaacgtgaggatattgggagcattttgaaaatactggaggaaaagctgtcactgggcgatttaaatccgattccccttgtcggcaaagccaggcgctgatagcgttatggctgccatgagagtcagcagtatcccagcttccaaggatgggtgtaaggtgggggtgaggaagaaaaggaacttgaagctgcctcctgtcccagaatcacaagacatctgttaagcccttactacctcattcactccactcacattaggttgacccacttgggcagcaagacaagcaggcctgcaaacttccttttcttcatcagccacagagacatcctcagctattattctggattaaggcagagatctccaaacagcagactaagatcagcctctagatctcaaagccttactgttatctctccaagtcagtggctgatctcagagaagcttctgaatagtgactagcaaagagtcactcaggctacttacaaatccaggacagcagcgtttttttttttttcttttttagagacagattcactctgtcatccaagctggagtgcagtgagccgagatcacgctagtgcactctagcctgggtgacagagcgaaactctgtctaaaaaaaagaagttatttttatcaatatatattaacatgcaatggatttattattattattattttatttatttattttttacttgagacagagccattgcattccagcctgggcaacagagtgagatcccatttca

SEQ ID NO: 400726 - DNA, 526 bp, Homo sapiens
tgggaggctgaggtgagagaattgcttgagccctggaggttaaggctgcagtgagctgtgatcatgcttctgcactccagcctgggtcacagagcaagacctgtctcaaaaaaaaaatagtattgtggtaatgtttatttcctgattttgataatatcactgtagttataaaaaagaatgttcttatgtgtttatatatatataaaagagagagtgatggtcgggcacagtggctcacgcctgtaatcacagcatgttggaggccaaggtgggaggattgctcaaggccaggaattggagaccagtctgggcaacatagcgagatctcatctctactaaaaattaaaaaattaactgagcatggtggtgcacagctgtggtcctagttgcttgggaggcagaggtggggaagatcacttgagcccaggagatcgaggctgcagtgagccataattgcaccactgcattccagcctgggtgacagagggagaccctgtctcaaaaaaagaaaaaaaaaaaaagcaga

SEQ ID NO: 400727 - DNA, 417 bp, Homo sapiens
gtgatctgcccgcctcagcctcccaaactcctgggattacaggtgtgagccaccacgcctggccttaaacaaggttttcttgagctgccatcttgacagatgccatctaacatacctgtttttaaaatgtgttaacaacacttgtttttataaattttctattgtgtcttttttttccaaattgttgcttcacagtgtaaaaatgctactgtaatgattagcttgaatgatgtccatacttaaggcatacagtgctgaattttacattagatttacaaaatcgaatattagattttctaaaatctttccctctcagccataaagtgtacttggtcttatagcagtgaacaaaaaccatcactaagaaaaaatgtttgtttatgtaaagcaaataaataattatctttaacatgcacc

SEQ ID NO: 400728 - DNA, 505 bp, Homo sapiens
aattgaatctaacagtttataaaaagaataatacaagatgaccaagggggatttatcctaattacgcaaggttggaaaagtctattaaattacaaaaaaaaaaattaacgtcccacctctttttcttcctaccatcccattttctgatactatctgccgttaacaaaacaaaccatcattcaaaatacgaggagtctgatgatgcagcttttagagatcaccatcccagggcccagggcagggtggagaagggtgggtaatagataggcagcagcaaacacaggatgacagtacttgcagcataggggtgattaggaattggaattttgagagggacttaggtcatccagaagtcaatgtaaacagacaaaaagaaggcgtaagagcacagtttgctaaacatcgaaacttgaaagtctaggaaagtaaaggaatcacaaaaaaagatttagagggtagttagaaaagcagagaagtgtaacatctaactcagttaaaaaaaaaa

SEQ ID NO: 400729 - DNA, 231 bp, Homo sapiens
gacctgacccgccctctagccttacactatcccgggacaatacgttgttcaggtcagcatgtcagccgcctcccacaccctgcgtgaggcagcagagaaaggagggagcggaaggtttgaacgtcagctggagtctcacctgcacctggacatcctgcacatctctaggaggatggtctcatttccccactgagacctactggcagagtgagaatataggcccctaaatgc

SEQ ID NO: 400730 - DNA, 745 bp, Homo sapiens
tatacatccacttttaagttaacacttttcacatttctcaaagaccgtatctttaaaataaaagattaagagctaccttagctggtaataaaactggtatacttaaaaaaaaatcagagattgttactttatcattgtacttgtttggcatggctaagatgtgttactggtcactaagggtgagatttcacttccctaacctgttcttgaaggccttcaacagatcccacttcttgttccactctagtagccacacttctaaaaatgatctgtgcaacatatataatatgcaagctgtagaatgctggctgttaaaaacggggtccattttcaaatacaacatttttctaaaccatgcacaaaagaacagccctacagggacactcttccatactgtatacatgccgttgccactacatgtgaatactggcagacgttagtggctaaagataaacattagataaaacataggtcttcattgagcagacctgaaatagcagagcaatgaagtacattacaaatcagcatcccactacattttaaaaaacaaaccaacaagggtgtcatgccaccagtcaaaaggtactttgcttaaactggcattctttaacatgcatgttgtagtggtaagtacttcatttcatacagccacagtaattaatactttgctaagggctacccagctgctaaaaactgctgttatctcatactgagaatgctagttctatacctttgctctcaggct

SEQ ID NO: 400731 - DNA, 502 bp, Homo sapiens
gtggtggcgtgtgcctgtagtcccagctcctcgggagtctgaggcaggagaatcgcttgaacccgggaggtggaagttgcagtgagccaagatcttgccactgcactccaccctgggtgacagagtgagactccgtctcaaaaataaaataataaaaaaaaagggaagaaaactagatgctatctctgggccaatctaccaagccatcatcagccattagtagcccccactggctaacatcaatttaggtgtagtcagtcatccgagagacctgagggactgggacacagtggggatgagttttgatgggcagggagatgagcactttctccagcaaggaactgaggagccacatccactccctgagccctggcatatctagattaggtcctgagtgaggactggagtcgcttcgccctgtttctaaatttttcttaatacttagctcaacaggaatcagcacgctctgtctgcagagggccagatagtcagtatattagtg

SEQ ID NO: 400732 - DNA, 427 bp, Homo sapiens
ttgcagcccctgcctttggtcctgttcccttactctcagagcagttcttgtaccacctcctccaggaggctcgctgtgatgtacccaggcccactgagtgtcggtactcttcctcctacaacagctctcaaattcagctagaattcaagttcagccagcaccccaggcagagcctccagcccacttaactgaggccagttcgcaagccactgcccacgaaacaccagaagctgaggcggggaaagcaggctccttgatgagccacaagggctgaggaggtggctgcctggcataagccgaccgctgtggacggctgtgccacagcacaggcccggagccaggagcccgctctggctctgcagcccggccacgctggggctcccatggggttgctggggccaggctgactgcgagagggcagcggccg

SEQ ID NO: 400733 - DNA, 515 bp, Homo sapiens
gcaagagaaaatctgcagagacgaccttctattcatttctgtaatagttttcttgccacaggagacttaagaagatttgtacagcctgctctcttttcattagcagaaagtgcaatgctgctgggtaagttaatgtgtaagactgtagaaaagaagagtgctgtatatatgaatttttattccatttaaaaaactatccttttacttaagtacaatacagctgaaaatataaataaatggtaaatatatttaatattttcttaatcatagacttagcatctggcttcattctgtttgttgaatgcaattccatggttcactaggttttggtatgaacatgttaaaattatcgttactgaactgacaaggaaacttgattgaatttttaacacagtcataattcttgtcgtcaaatgtaacagtatttaatgatttctttgtatttccatatgcaacaaaatgcatcagtgttttcaggcttagtttggccattccattaaactgccaggactaaa

SEQ ID NO: 400734 - DNA, 670 bp, Homo sapiens
ccagatggactttcctgagaaagcaatagttttcctgagatctgtagggtaagtaggagttcatcaggcaagagtaagacgaagtgtggagagccttatagtcaatgagagaatgtaaaagagacaggagaagattgaggaaaagagatggtggatgctagcatgtttaaaggtctagaatgaggagaataagaaagagtttgattatcaaagagattgagaggtagtgaaaggccagatcatccagatcatgtagaatgtgttaggagaaagttaggaggctgggcatggtggctcatgcctataatctcaacacttcggaaggctgaggcaacaggatagcttgagcccaggagtttgaaaccagcctgagaaatataatgagatctcatctctacaaaaatttttttaaaataaaaaatcatccaaatgtggtggtgcacacctgcaatcccagctacttgggaggctgagttgcaaggcttgcttgagcctgggatgtggaggttgctgcagttagccaagatcgtgccactgcactcaagtctgcgtgacagagtgagaccctgtctcgaaaaaaaaaaaaggatttcatcctaagagcaatgaaaaaaactactgatagattttaattcatgatttgacatgatcaaatatgcacttcaaaaag

SEQ ID NO: 400735 - DNA, 494 bp, Homo sapiens
tagagaaagggtctggctctgtcccctgagcttgagtatagtggcataatcatagctcactgtagcctagaattcctgagctcaggtcatcttcccacctaagcctgcttagtagctgagactacagccatgagctatgagctaccatgcctaacactatcctcattcttaatcagattaccaaagtcacaaaacacttgagaaaaatggaatttttaaaatgaaaatttatgaaaaggctgggcatgttgtctggaatgacaaatgggtagtacgggacaaaaaggaagttgcagaggtagaaacccacaaaaagtatggttctgggagcttttatcaattggcagaggttggggatggctctcgactcctccagatcattacatggtttaggtcaagcttaaccagatgcccaaggcaactaacacctgcacttagtaactttacaattctgtgctattgctgtttctcagttcatttgcttctcttgggac

SEQ ID NO: 400736 - DNA, 190 bp, Homo sapiens
tctttccacctacaggttcccgacttcctatttatgtctcatgacacttcttagcattaagatagtaaggaatcatatttattgtgcatgttatatattgtctgactccctcactagaatgtaaggtcacagggaagtgatctctgttttgtttgctgatgcattccaagtgactggtaaggtcgtctca

SEQ ID NO: 400737 - DNA, 310 bp, Homo sapiens
gggaggggaaggagggggaggagagggaggagggggaggagagggaggaggaggaggaggtgaaagagggggaggaggggggaaggagcacagctttcgacccaggctcttcaggtgaaggaaggaaagaaagactggttcccagcgcgccctaggagagaggccaggaatacaaggccacgaaagcccatctgtttccaggcttctgtgatttgttttcccttttctttgaataccccttgatttatgagactaggggtgaagatctcttctcatttaacttactttgaagctgattcaagttgttcca

SEQ ID NO: 400738 - DNA, 366 bp, Homo sapiens
agacagaagaggcgacgttgctttcttaaccactggatttgcagtgctgtggttctcagaagaggccaggacaggttaatccactcgcttgggaggttgaatgtacagctggtataaaaatggtgctttgtcgtcatgaagaaggtgtattctgggatcaaaccacctggctggagatgcttactaacctcagtttcttcatctgaccttacctttctaaaagaataagaagaagatgatacatattcctctaaagtcccaacaggaaccttttcccctcactccctccccagagatgtgtatcatttccatgagtgtctgtacttttacaacatgtgcatattaataaacaaaatatgacaaatt

SEQ ID NO: 400739 - DNA, 743 bp, Homo sapiens
cgggggtaccggtccgtgtttctagaaaaaataaaaattcggttgaatgtacagctggtataaaaatggtgctttgtcgtcatgaagaaggtgtattctgggatcaaaccacctggctggagatgcttactaacctcagtttcttcatctgaccttacctttctaaaagaataagaagaagatgatacatattcctctaaagtcccaacaggaaccttttcccctcactccctccccagagatgtgtatcatttccatgagtgtctgtacttttacaacatgtgcatattaataaacaaaatatgacaaattattttgtcttaatatttgcataaatctagccatactctacaccacttttgcaactttcactattatatattttgaagattatccgtgtttatgcacataagtttatcattttaactgttgaatagtggttcattatatgaattaaccataattcatctatttccctgagtgacaattaggtttctttttgtttttatgctctgatgaacaatcttgcaattattatctttgtatatgtcttcatgtataagaaattctccagggtagacacttagaagtaaagggtctgactcagagagtctgtggtattttaaaatgtattggttattgtcaaattgttcctcaaagtagatgtaccaatttacattcctacagtggtatataacagtttttttttctccacatcctcttcaacactcgtcattaccagc

SEQ ID NO: 400740 - DNA, 745 bp, Homo sapiens
gagcggtggaggagttcgatcgtggtgggaggcggactcgtcggttgaatgtacagctggtataaaaatggtgctttgtcgtcatgaagaaggtgtattctgggatcaaaccacctggctggagatgcttactaacctcagtttcttcatctgaccttacctttctaaaagaataagaagaagatgatacatattcctctaaagtcccaacaggaaccttttcccctcactccctccccagagatgtgtatcatttccatgagtgtctgtacttttacaacatgtgcatattaataaacaaaatatgacaaattattttgtcttaatatttgcataaatctagccatactctacaccacttttgcaactttcactattatatattttgaagattatccgtgtttatgcacataagtttatcattttaactgttgaatagtggttcattatatgaattaaccataattcatctatttccctgagtgacaattaggtttctttttgtttttatgctctgatgaacaatcttgcaattattatctttgtatatgtcttcatgtataagaaattctccagggtagacacttagaagtaaagggtctgactcagagagtctgtggtattttaaaatgtattggttattgtcaaattgttcctcaaagtagatgtaccaatttacattcctacagtggtatataacagtttttttttctccacatcctcttcaacactcgtcattaccagc

SEQ ID NO: 400741 - DNA, 797 bp, Homo sapiens
agacagaagaggcgacgttgctttcttaaccactggatttgcagtgctgtggttctcagaagaggccaggacaggttaatccactcgcttgggaggttgaatgtacagctggtataaaaatggtgctttgtcgtcatgaagaaggtgtattctgggatcaaaccacctggctggagatgcttactaacctcagtttcttcatctgaccttacctttctaaaagaataagaagaagatgatacatattcctctaaagtcccaacaggaaccttttcccctcactccctccccagagatgtgtatcatttccatgagtgtctgtacttttacaacatgtgcatattaataaacaaaatatgacaaattattttgtcttaatatttgcataaatctagccatactctacaccacttttgcaactttcactattatatattttgaagattatccgtgtttatgcacataagtttatcattttaactgttgaatagtggttcattatatgaattaaccataattcatctatttccctgagtgacaattaggtttctttttgtttttatgctctgatgaacaatcttgcaattattatctttgtatatgtcttcatgtataagaaattctccagggtagacacttagaagtaaagggtctgactcagagagtctgtggtattttaaaatgtattggttattgtcaaattgttcctcaaagtagatgtaccaatttacattcctacagtggtatataacagtttttttttctccacatcctcttcaacactcgtcattaccagc

SEQ ID NO: 400742 - DNA, 870 bp, Homo sapiens
taatcttttgcccttacatgtaaaaggcctaaatgctgttccttttctaaggcagcccctgaaaaatgactaattacgagtaaattttctgcatcctgggatgcagccagcccttcagaagagatttgattctgtagctcaactagaggagttactccttcttcacataaacactccttttcaagttcaagaaacatctgcactgagtctgtgtcagagagctgttctgcatcaatagtacccacagtacatgctgaatctgaaacaagtccctctaacccctgagcagttctgtttgccacctcaccgagaatatcctcacctgtaagaacacaatcgcaatccaggggtatatccttgggaacagtagccaactggtccttggctggctgtgggtcatcagggcaacaaatctgaccaagagataggtggccaaaagtcctcaagacagcagctaagcaatcggatccatcctccaccactgctgtgtttgcttgttctctttcttcaaaaatatctgccaggctgttcttctcatctgccatcagaaaagtcttttccctgtctgacagtttctcttcctcccactctccctcagcctccatcataatccatcgctcatcctcctcaaactttagctcagactctgttttctctctcaggctgggggttatgagaacatgcaattctggatctaacagctcttcactcaggcaaggggagagaggtggcatttccacagtgcaggctgtgtccccaagggggtgctgcttctcactgaagcctcccttagctaaactttttgtggccctcggccaggttgcacttgagaatctggattcctgcattacatctgtgttaccacttgtt

SEQ ID NO: 400743 - DNA, 720 bp, Homo sapiens
ggaactaagtgatcaacaactctggcagcagtttatgtaataaaagtcacatatataccttttgtagaagaaaagttatcagtcatacagatcacatccattacaagggataccagcaccttgttatctttacgtaggcaacattaccagtcttcaaaggactgattataatactatttggggccatactcatttttgttttttttgagatggtcttgttcagtcacctagactggagtgcaatggccatctcgactcactgctccctccgttccatgggctgaagcgatccagtaataagcatcatcttttattatgaagacaataaaatcttgaggttgtgttcacttaatctggttgcagttggtcttttgggagggaataaactagggccatcaataaaattccctttgtagaaaaaattttcttaaattaaataaaattctggctaggtgtggtggctcatgcttgtaatgccagcactttcggaggccaaggcgggtggatcacttcaggtcaagagttcaagaccagtctggccagcatggtgaaaccccatatctactaaaaatacaaaaattagccaggcgtgacggcacacgcctgtagtcccagctacttgagaggctgagacaggagaatcgcttgaacccaggagacggaggttacagtgagctgagatcacaccactgcactccagcctaggcaacagagtgagac

SEQ ID NO: 400744 - DNA, 612 bp, Homo sapiens
cagaggatccccccaacactctctatcctgtggctgggtgcagtggctcaccatggcaaaatcctgtctctactaaaatacaaaaaatggccgggagtggtggcaagcacctgtagtcccagctactcgggaggctgaggcatgtgaattgcttgaacccgggaggcggaggttgaagcgatccagtaataagcatcatcttttattatgaagacaataaaatcttgaggttgtgttcacttaatctggttgcagttggtcttttgggagggaataaactagggccatcaataaaattccctttgtagaaaaaattttcttaaattaaataaaattctggctaggtgtggtggctcatgcttgtaatgccagcactttcggaggccaaggcgggtggatcacttcaggtcaagagttcaagaccagtctggccagcatggtgaaaccccatatctactaaaaatacaaaaattagccaggcgtgacggcacacgcctgtagtcccagctacttgagaggctgagacaggagaatcgcttgaacccaggagacggaggttacagtgagctgagatcacaccactgcactccagcctaggcaacagagtgagac

SEQ ID NO: 400745 - DNA, 754 bp, Homo sapiens
tagaacaactttattgagatataattcacatatcacacaattcatacatttaaagtgtacaattcaagtatacaattcaaagtgcacaattcatgcaataacttttggtatattacattattaatttttttaaattatggcaaaacatacataacataaaatattcacattgttgtgcatcatttcttatgcacaatatctggaacatttttgttctggaacatttttgttattcgaaacagaaattctgtaaacattatacgataattccccattcttcctccctccagcacctggtaatctctctctctctctttcttttttttaaagacaaggtcttgcactatcactcaggctgaagtgcagagggccaatcaaatctcactgtagcctccacctcctgggctcaggcaatcctctgcctcagcctcctgaatagctgggactacagtgtgagccaccacacctgggtgccctctggtaatctctgatttgcttcctgtctgtatgaatttgcctattctagatatttcatataagtggagtcatacaatatttgtccttttgtgtctggcttatttcacttcacataatatttccaagattcatccatatcagcatgtttcagatcctgattcctttcctatggccaaataatatcccgttgtttgtatataccacattttgtttactcattcatctgctgataggcccttgggttgtttcccatttctggctactgtgaataatgctg

SEQ ID NO: 400746 - DNA, 405 bp, Homo sapiens
tctcatgctgcagggtggctgcgtgtgctccgtacatcacacccatatttcaggtagggacggttcccggagggtgctcagcaccatgccgactactgctggctggcacgttcgcacgtggccatgtcagctccaaggaggatgctgacatcctgctggctggcacgttcgcacgtgtccatgttagctgcgagggccatgccgacatcctgctggctggcacttccacaggtagccatgttagctgagagggcgatgccaacatcttgctggctggcacgtttgcacgcggccatgttagctgcgaggacaatgcttctgcaacttttggtttcttccctttcatcctcccacccctgaccgtttttgcctgggagcaagtgcctaataaattacctgcactca

SEQ ID NO: 400747 - DNA, 604 bp, Homo sapiens
tataagtaggattaatgcccttataaaagaggcccaagacagattgtaaacattcagagaatagtacccagtttccttattttacagataaagcttttatgaatagaagataagtgacttgttcaagattattttgttattgacaacctaggtcatctgagtctgaatgtaaatctggcttagttttacctgtactatcctctgaaagttcccaggccactcaccaggttacaacaacacatcaaattcagaaacagttactatattcacattatttccctctacccataaaatagttaatcaaaagagtacatgcaagcaaaagggcaggaagccacctagagaagctgatcacagccatctgtggtatgaggtatatggtaaatattcaaccatttatttaatggaatgagtgaatgttgaatctgtgatcatgcaaatgataatatcaatgtacaaaatgaaaatgtgatttttaaaatttctgtatttatttgaaccagattgtattataacaggatagttagattgctaatgtcatttcttataaaatgatttttcatgatttgaattttctaaaaacaagcctaacttctacctttta

SEQ ID NO: 400748 - DNA, 860 bp, Homo sapiens
gaccgcgtgctctttgattcgcatcagcagcggctgatggcccctcaagtggttcctgtttgctgtctcccagcattgcggcaggtaggcggggtgcagcacagggcacaggcccctgggcctcagtgcctccgacgtgccagttccggctgtggcggcgggggggttgcggtgtgcctgggcctttggctttgccccgaccaccctctaacagggctctgcccgctcttggaggtgaagggtacacttgtgcctggaagctgatggaaagggcttctgaatggactgcaagcaactggctcagtggtcacctctgaagtcaaataaagggaaaagtttggagcacaagaaaatgagtacatagatcaaagtgtccatgtcccatgtccatgtctggcattttctctgccttatgtccctgatggtgggggaagagaagggaacagatttacagagacccggacagctcacctccaataggagccatatatcccagtggactggacgcacccaacacggaggcagcagccgagacttacaccgcaaggccttggctggctctattgggccaggaccccatactgggagtgcggggtaggggcaggttgaattcagtttccagagtcaggcccctgtcagaggggggaagtgattgtgaaatattttaaatgcacagagatgagctgatggacaggtcttaatgaaggattaaatggacacgtttaagagcctggaaagcaccaggcagagttccatgggcccagaataactgcttgtctctgaccttttctgtcttgggaacatgcacagctttagctgaaagaactgagctcatggcaccagtttcaacccctcgcttc

SEQ ID NO: 400749 - DNA, 297 bp, Homo sapiens
aggcttgatctctgagaccaaaagtgaaaggacaaaggatgaaccaaattaggatgaaaagaatgatttttttccaacctctttttgctttgtgttgtggtaggatcatttgaggtcgggaaagtttctgaagctgtcgtgcgacaggtggttacccagtgtacagaaagcataggggctgacctgtaactggtcaaataacatcactggcattattaatccagggttagggaggcaatgaaaggacctgaataggagaggttacaggaccaaacagaatgttcatagattaaaaaa

SEQ ID NO: 400750 - DNA, 275 bp, Homo sapiens
aggtcaaatcccagcttggccactgcgaggctatgactgagcaatcattgagtctcgctatgtcccgattttcttgcctgtataatggggatgatagcgttgtgaggatttagtgagttagcacgtcagaagcccctagggtggtgctcagctcatagccagtgctcagcagaaattagctgctgctgctgctgctgttccagggtgaaggggtagaagcttatgccacactcagtggagttttttaaacagtgctatagaccaaggctgtgttt

SEQ ID NO: 400751 - DNA, 726 bp, Homo sapiens
ctacacaacggatgtgtagctctagcacctgacaggtagaagataccctcaaggcgcctcctgtagacacacgggtaaactcacacactatgtcctatccccacgcagcagtcggaggaaccaggctctgggccaggacagtttccagtgctgtgaagaaacgaggtgagcagtatccaaggggctcaaggataatctgctgatttctttcttgtctttcacacagagaggccaccagcaggaaagcagtgggagttgggtagctgctggggccagcatgtcctcttccacactacctgcctttcagaactctgctcttccgcttgtcccgaagtcagggctggcaatcttcataatcaaaggggagttggaaaagaacacccactaagaggcctccatggcagatgtcaattaaattgccccccccccccaaatctcatgacagtttattcacatcagtagtgtgggaagttacaatgttttttttaaaaaaagcttctttccttggctttccatttctttgaaaaaagggtttcttttgaatttttaaagctctgccatactgaacattcctgtggaaaggtttaaaatgcagagcctgaggtttttgcttttcagaaaaataaaaatcatagagattagctagtgtaaatgttaagctataaattatgtttcaaactgtgaaaaaaaaaagttttaaagaatgaatgaaataaaacctgaaaa

SEQ ID NO: 400752 - DNA, 473 bp, Homo sapiens
ccacttccctcccaccccgtcccgtccgaggcctccgccccctgcccctccgcaccccccgacccaggcacgcgcagcggggagcagcccagcctagcccgtctcactgctttggttttgaaaggtcacgtatttaccttagaatttcagcaccttccaacttactgttttaagtacctttaaccagcctattggctaaaaaccgaaacggtcctacccgcgactaccactgctccagtgacaatgctctgctgctacttatttaacggagctcaaggtttataattctcgaaagaatgttgttccccttccctttcccctcccgcctctgtacttgactctcgtaagaatgaaatcagaaaagtgcagaaaacacaggctcctagcaatggttcggggcaaacgggaggggcgaagaagggctggagccgccccggggccctcgctccggcctcgggagggcgtcgcggccg

SEQ ID NO: 400753 - DNA, 369 bp, Homo sapiens
gaattacattaactataaataaatttcagcgtgaatatagatattgccagcattaaaggaagatggcatgacaactactagcaaagttttcatttaatttctgaaagtgccaaagtggttcacaggaacagagatacaattataactggtcacctacctcatggtcacctcaggagagcaggcaaaaactacctgctacgtagtgggcaaacccatttaacaccaaactcagagttccttccactgtgctgtaaagcctctctagcatatgcttgtgaagaaaatggctactttaaataagaagcactactgagaaatgttctttactctgcatgcatcttcaaaaatatttgaaattacccacaatga

SEQ ID NO: 400754 - DNA, 505 bp, Homo sapiens
acttcttgtaaagaatagttcttttcacatatacagtcagagatattaaaatgcatgtttattagcaatgtgtagaattttattgtttggtgctcacagaagcaatgtaaatttccacatctgttaggtcactctgagagtgtatgtgttgtgtggggagagagggcatgcccatctgtttgagctatgtcaccaaaatctatatcaagatttttaattaggctgagagtggtggttcacgcctgtaatcgcagcactttggaggccaaggtgggcagatcacttcaggtcaggagttcgagaccagcctggccaacatggtgaaaccctgtctctactaaaaatacaaaaaattagctgggtgtggtggcacatacctgtaatcccagctactcggaaggctgaggcacaagaatcatttgaacctggggggcggaggttgcagtgagtgagatcacaccactgcactccagcctgggtttcagagtgagattctgtttcagga

SEQ ID NO: 400755 - DNA, 214 bp, Homo sapiens
atttctcaatcggttgcatattctaattattgtattactagttaataatcagttttgtccaggtcactataacatattattaaaaagtttatttgccttttctaatttatctttgcagtaaattatgctttggctttaaaacttcctattaaaagatcataatgagacatacaaattattaaactgtcacaaatgcattcaaatttgtttgttc

SEQ ID NO: 400756 - DNA, 369 bp, Homo sapiens
aggtgtcctggagtgggatctgggaggtggctctcttagggtttggcacagggtggggtgagagtgctgggaacctagcaggaccagattttctgctaatttgagggctacgcagaaaactttgtttagaaaagcaggaatctttctagaacatcccagtcttccttctttctggctttaacaaatatgtcccaggtgcctgtttgcatgagcaccaggagtgccagtgtcagtcctgcttgacttcctgactccatcatcagcatcaccattcagatttgtataaaaccatttgtaaactagttttgtgagggagacactcagctaagccctcagtatgtggattatattaaatccagacacaaacct

SEQ ID NO: 400757 - DNA, 579 bp, Homo sapiens
atttatgaacactgaacccaaaagagctgaggtttccccaattttggagctcgtgtagaaagctttcctcaatctccttggatggaaaacttaaactgctcccactgtttagcacttcctgcagtttatgactctcagttcaggctctaactcaccagtaggggaatagggatattctggtgtatatgggtctttctgggcaaaccagtgaagcaagtctcacagctgttctgtcaagaacccaaattcccctaacctgggttctaagactgggccagccaaatggcacttttatagaacctcttcccaaaccagcgctcttgggcgatctttcttctgaaacgttatgtgtttccaatagggaggaaaagaagaaatgaagtaactttttgtccaggaatactcctttgtaaaggttgatttcagggctagcaaagatgccttcatagaaggcagttatttgtgaaagccaaggtgatggggtttgaaattgacaaagggatgaggacttagcttttcttctgaaggtgactttctgcccatggatcttccatttccattaatcagaagtattcgtta

SEQ ID NO: 400758 - DNA, 564 bp, Homo sapiens
aaaggctgtggaaaatgttcctgattgacagagatgacagacacacaacaagcagatgcaacacctgatcccagaccacatcctgtgctggagggaaaataatataaaagacattactggggggactggaaatactggggtgcagcatctagacgggttttgtaagctgacaatggtgctgtggtgatgagaggacacccccattcccaggaaacagcacctctccatcctctgaatcaccctcttgactcctcagggaccaatgtctagcagcatccacgtgctctctgtctcttaattttcaaagtttctctactaactcattttcaggctttaaatataaccaagtagctcatactaaagatgcaacccaaacacctcccttctagaccccaagttttcagagtcaaacattttccacagccatctccacccctccctctccctgactcttcaagctggctcaatctggcttcctttgtaccttctcaaagtgactcaggacctcctgaccatccctgtgccaagtccaatgccatctttcagccctcgtcttctgtgttt

SEQ ID NO: 400759 - DNA, 325 bp, Homo sapiens
ttttttttaaacaaagactcacattaagaaatatcattataaaatttcagaacaccaggaataagagaagatcctaaaggtttccagaaagaaaaaaacagctttcttataagggtcttggaggccaggcaccgtggctcacgcctgtaatctgagcactttggaaggcagaggcgggcagattacctgaggtcaggagctcgagaccagcctcatcaacatggcgaaaccccgtctctactaacaatacaaaaattggccaggtgtgatggcaggcacctgtaatcccaaccactcaggaggctgaggcaggaaaatcgcttga

SEQ ID NO: 400760 - DNA, 531 bp, Homo sapiens
atagaagtttattgactttgtgataaaattgtcttaaaagatcttaactgaatgtctaaagctttttaagaacttgtttttatctaaaaattttaatcaattggatagtagagatcatacgtattctcatgtcactgtttactattctagctaagcagtggcatccatcttgctgaaattcattttctggaattaaagtttagtttttgttctgtttgtataatatagacttactaagcaatgtagactttagtgtagacatactgaacaaaaaagtttttgcaaaagcaaccatggctcatgcctgtaatcccagcactttgggaagccgaggcaggcagatcacaggaggtcaggagttcgagaccagcctggccaacatggtgaaaccctgtctgtactaaaaatacaaaaattagccaggagtggtgctgtgtgcctgtagtcccagctactcgggaggctgaggcaggagagttgcatgaacctaggagccggaggttgtagtgagtcaagatcgcaccactgcac

SEQ ID NO: 400761 - DNA, 316 bp, Homo sapiens
cccttccatgccaccttccagttctggctagagtaactgccacaactgaaaatctgatcctatcactcttctgccagagctgccccacatctaaccttaggaaggaagcccaagccctggacagggctcttgggccctcactggcaggaggcttctgcctcatcccccttgtggcccctcctctcagtgtctcagtgtctgatggcgccaccaacagaaatgtgcatttatttaccggatacatattcttatttacaagttatatatgtgctctactgaactcattgtatgtttataataaaaaattcaaaacaaa

SEQ ID NO: 400762 - DNA, 367 bp, Homo sapiens
gattacaggtgtgagccactgcgcccggcccagttatctttatattttaagaaacatagttcaacttctactttttccatcaacatatttaacatatttctatacacatcagtatctacagccttttcttcctgaatgtcctgtaacgtacaagttccttgcctctcttccaatttctaactgaaatcctgtggaattttagtgcaagattatatttttatttcattctatctcaggaataatttattaacaattaccttagggttttcagccacattagcagcagttattttctactgtgatgggagggcattgcggggtggatgacacatgcaaagaggggcgcttctcccttctggaagctttc

SEQ ID NO: 400763 - DNA, 345 bp, Homo sapiens
tatacatcttgggattgattgcaaagaggcttaggatgatagtgtctgcatcaaagatgcagtgatgcctttgatagaatgaatcactgctactaaaccatcttaaatgagaaccagcttttccctccaaaccaatcggattgatctgtgcattgaaatatgttcctgtcacgatccttttactgcattggagacaagaatgctgcaaaaagaagtgccagaagccatgcttgctgggattgagaatatcttatttacggtctgagcgcattatggtttgaccactcctctatcgtacatgctaattccttgaacattactaaaggatcctctgaacttctcagt

SEQ ID NO: 400764 - DNA, 414 bp, Homo sapiens
ggcttgaattctcttctgtcagtagctacagaaaatcaaagaaggaaatatcaaactgtgttttcagggccactgactctgtgacttccgctgtctggccttcatgaagccaggcggtcaaatgggacacacagaaactcgaatcagtgagtccttcctcctggcctgaggccccagcttgatcccacaacagggaaaattctggaggtttctgtgttgacctgggtggtagttatgcagcggtgttccctttgtgacaattcatcaaaccattcacataatgtgttgccttttctgtaggtatttttttcttcaatgaatagtttaataaacacaaaaaagaaaatatggtcatcttatctttggacagtctctcaaatgttttataattaattaaattctttaacttatgta

SEQ ID NO: 400765 - DNA, 416 bp, Homo sapiens
gtgctgggattacaggcatgagccaccatgcccagcctggaggtggtgtttctattgataacaagtaggtgactggcctagagatggaggtcatgatgactgcaaggaagagactggacccatacaatgtactacccccaaagacagctttaggcaccaaggaagaccctaatttagtcccctccatcaccaacaagagaatagtgggtgcatctgtgaagaggaaaacagtgctgtcatctggttttggccgcacaaaggcaagacccagcaatgccccagctatggagcccattacaagctggtacccatcagctggtgcattgagcgcctgcaccaagttactcaaaatgtgctataaagtttcatctttccaataaagaccagccattgcattggctccttctccttctgca

SEQ ID NO: 400766 - DNA, 578 bp, Homo sapiens
ttcagtaaataaaggtcagagtcatattacttgagaccttggatcaaattaatacttctaccaaaatattcttacaacccatttttaagtaactatttcaaaagctgtattagcataaaccgtttctgccagctacttgggaaactaagggaaaaggtacctattgagtatgtttgtcttcacagcatttatgagaaagacattaagttacgtggttttctctcactaatagtggcaatgtgggaaaattccagaaaaaaaatgcaaaaagccaggctttccaaatcatgcaagatattttttctagagcaggaattggcctagatcacatgtggtttgctgaatcccagtcctggcatcataaagctgagaaaatacagtgtaggtttgaagccgacacaacagcagagtaccaaaaaacacatggtaggagtgggatccacatgggaaaagcaacactgagatggaagttaataaagtgtatatatttatttatatatttattatatttatacatacggtgtctatatatacacactattatctggtctttattaagatttgctttattatagaag

SEQ ID NO: 400767 - DNA, 485 bp, Homo sapiens
taagtttatgtattcagtttttattaaatatttctgtaaaattggtattccataattgtttaaaaatgttttttgacagcagtatgactcgatgctatttgaagaatcacattttaagcacttgagaggaaaaagtatatattctactagcagtgaaattctttatagacaaactttatgagacaacatctggtattgctcttcacttaactgtctataagaccaaaaataatagctaaaataagtaaagctactaatactgttaactgagaaaaccatgctgatctctgtcttctttttttcctggtggaatttgtatcttctttgtctactagaaataaatactcaaattatgaagcataagttgatagtcttattttattactctcaccattagatgacagcattctgaaatcagagcttggaaaccagtcaccatcaacctccagcctgggcgacagagcgagactccatatgagtaaaag

SEQ ID NO: 400768 - DNA, 438 bp, Homo sapiens
attttcacctctctactatgtacgcatttcctattgttgcatttactacaatagactaagatgtagctataccagtggttttcaaattttaatggtgtatcagcatcacctagagggcttgttaaaatacagattgctgggttttacctctgtttctgattcagtacgtctgtggtaagaaccaagaatttgcatttctaacaagtttcaggtgatgctgatgctattggtctagggactgccttctaagaactctaatctagacattagctgctttacatgtttgtgaaatccataagagctgaagttgatgcatcttttttctccaaatccctggacaatggcatagaaggctcccccaaaataatgagtgaattattattttaatctattttttcagttatttagaaacactgtgtgtaccacattttttcccta

SEQ ID NO: 400769 - DNA, 258 bp, Homo sapiens
ggactgtgggacacacaaccaaaattaggaaggcaagaatcctcagtaattcataaaatctcgagtggggcaggaattcaggttgccatgggaaacccatctcaggctcctcaggcggtgggtggcagtcagggagcctgccctgccactgagtaaagaccaagtggcagccctggcccggccacctgccctgatctcccgctgttctgcccccatgggctttccgaccggctgacactctggctcactgtatccacg

SEQ ID NO: 400770 - DNA, 347 bp, Homo sapiens
aaatctcctatcaaccaaaaataatactaataataatcatgggaaattaaaagcaaaaacttgattgatgatctctgtgtgacattataaaaactaccccgagttggggactagaggtaagcaagtaggttgacgatcacttatcacaaacccaaggtgtaatgttattattttaaaggaaatttgatttgtatttaagcaataatacataccagataatttctagataattatttatgtctgaatttaaatgtatctattgagcaaatcagatacatatatatttatgtgtatgtgtctatatgtaattctattctttctttttataaagactcaaatatttctga

SEQ ID NO: 400771 - DNA, 639 bp, Homo sapiens
cggtggctcacgcctgtaatcccagcagtttgggaggtcaaggcgggtggatcacttgaggtcaggattttgagaccagcctggccaacatggtgaaaccccatctctactaaaaatacacacatacacaaaattagctaggtgtggtggcaggcacctgtaatcccagctactggggaggctgaggcaggtgaattgcttgagcccgggaggtagaggttgcagtgagctgagattgcaccactacattccagcctgagtgacagagcaagactctgtctcaaaaaaaaaaagctgtggttctatatctcaaaataataaaagccatatatgacaaacccacagctaacatcatattgaatggggaaaagttgaaagcctttcctctaagatctggaacaagacaaggatgctcactttcactatttttattcaaggtaatactggaagtcctggccagagcaattaggcaggagaaagaaataaagggcatccaaattgcaaaagaagaactcaaattatccatgttcacagatgacataatcctatatttagaaaaacctaaagaaaacactggttataaacaaattcagtaaagctgtaggatacaaaatcaatgtagaaaaagtagtagcattt

SEQ ID NO: 400772 - DNA, 426 bp, Homo sapiens
catatttgtgctgggctccttttcactgaggctgaatgccaaataaatattttacatcttccttctagtttgtggaaaataaatagggtatgtaatggaatgccctagtgaacacaagccaagccaaagattaaattcctggggttttgttgtttccttttctcttattttgcaagggacataccagttacaactatatatatatatgtatatatacattgatactctgtgtgtgtgtgtgtgtgtgtgggtgggtgggtgggtgggtgtgtgtgtgaagtaaattacatataggtcaaaaagtcaccttgaaatcactgaaggtagcttcctttgacaggcagccatagatgaaataaaatagcccagtaatatggtggaaggagtattagtttccaaggactactataacaacttaccacaaac

SEQ ID NO: 400773 - DNA, 158 bp, Homo sapiens
ctgcatcaccagggcaccagaaagccattgagactgagtgagcaggggctgggcatggggagacccaccagaggagcagctatgtagggctcatatgcaggtaggcacgattaggatttcctaatatacctaatacatttccccatataccccaaatg

SEQ ID NO: 400774 - DNA, 282 bp, Homo sapiens
ccaatggctttcccaagtcatttaccagggtagcacaagatgccttacaaattaccagagtaaagtaatggccccaacaggtatgcttttgaggccacatgaggagatacacagctgcaggattccctatcagcaaagactgaatgatgtcaaacgttcagaaaaggagaaactaagtgggtgtagcacaatcaatcactttgcatttcaaggtgaacttgcagctcttatggggagggaattctctatgtcattttccacgtaaataaagtaatgagacca

SEQ ID NO: 400775 - DNA, 629 bp, Homo sapiens
aagatatttatttttccagtggacccatgtagattgcctcaaattttcatgaatttttggatacccatttttctttaaatagttacttggtttttacttttgtctttgtattggtgggagagtaactcaagtggacgacaagcagtgggccaaagtgttcagcctgggcaatgttcaaggatggaacagtgggtaggaaaagatataacacagacatagagggccttggagatgaatggaaacagagagatcatctaatccaaggttttcatttaccacaattttgtgtgtgtgtgtttgtgtgtgtgtattgaagcatccattacattgtatcccataaatatatacaattattatttgtcaataaaaaatttgaataaaaagatgaaacggctcatggaattaaaatgatttgctcaagagcacctctagtaaaatgacaggaccgggattaggtgtctttccagtaatcaactttgtcaaactttgttgacgtccttcacaggtataataagagtttttgaccaggaaagcattttgtccccaaaatgctgaattaggaactgagattaatagctataacaatctatagcattcatatgaggtgatttcatctgtatttgattgcc

SEQ ID NO: 400776 - DNA, 388 bp, Homo sapiens
ttttggagaaagggtctcactgtgccacccaggtgggagtgcaatgggtgacagagcaagactccatctaaaaaaaaaaaacaaaaaccatccaccaaaatgggaagaagtgatgaaaaattacagtccaagaagaagggccatagctgtttaaatcaattggtatatttgttatctaatataaccccacgtaacgacaggtatttaacaaatgtttctgctgaatttgacgattccatttcccttacatcccatatgcaatccatcagcaccccacatccaacccatcagtacatcctgtcagcattggctcccaaatataacctaaatctaacacatatcctactatctctgctgctacaactttagtctgaaatctcataatctc

SEQ ID NO: 400777 - DNA, 3035 bp, Homo sapiens
  misc_feature (67)..(67): n is a, c, g, or t
aagggctactccgggatctacggacccgggttcccctggcgtaggtcggccctcggccgcagggtgnggctgggcatgcagccgggaccccgggcgtcctgtcccgttcctgcgcggcgactgcggccccggcgccctctctgggcagctccgcgcccgcagcctcgcgtctcccgagattgtgcggctgtaagcaacacaggttcgcggcccgactcactgcaccgagacgctgagggctgcagcagaaacagtttaatagccagagaggggaggacaccccagatccgcctccctgagggatttggggtctggacgggggcggctgggtgtagggtcgttggttggtggggaagtgaggggtgaatcctgggacaggaggtgaagaaaccgcattctgctgaatgggctccctcgttgggacttcaacctgattggcgccagcctttgctgggattcaggatctgagaactccggcgactcttgagcagttctcagagatcttatccccaggcacaatggggaagccggcggtcagcgtctgctgtgacctgactctcagggaggcggccccttgaggcagcggggctgagggcacctggttaatatctaactgcaatctcgcctccagcctggctcgcagttcctgtgaacccggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagccttcagttaccacaactcacttcaaacacatgagaggcttcacactggaaagaaaccatataattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgagagaacgcacactggagagaaaccatatgaatgtaagcagtgttctaaagccttttctttttacagttcctatctaagacatgaaagaacacatactggggagaaactgtatgaatgtaaacagtgttctaaagccttccctgattacagttcttgtctaagacatgaaagaactcacactggaaagaaaccctatacatgtaaacaatgtgggaaagccttcagtgcttccacttcccttcgaagacacgaaacaactcacactgatgagaaaccctatgcatgtcagcaatgtgggaaagcgtttcatcatctgggaagctttcaaagacacatggtaatgcacacgagagatggacctcataagtgtaagatatgtggaaaaggctttgattgtcctagttcactgaaaagtcatgaaagaactcacactggagagaaactctatgaatgcaagcagtgtgggaaagcgttatctcatagctcaagctttcgaagacacatgacaatgcacactggagatggacctcacaaatgcaagatatgtgggaaagcctttgtttatcccagtgtatttcaaaggcatgaaaagactcacactgcagagaaaccctataaatgtaaacaatgtggcaaagcctaccgtatttccagttctcttcgaaggcatgaaacaactcatactggagagaaaccctataaatgcaaatgtgggaaagcctttattgatttctattcctttcaaaatcacaaaacaactcatgctggagagaagccatatgagtgtaaggaatgtgggaaagcattcagttgtttccaatacctttctcaacatagaaggactcacacaggagagaaaccttatgagtgtaacacatgtaagaaagccttcagtcattttggtaacttaaaagtacatgaaagaattcactctggagagaagccgtatgaatgtaaggaatgtgggaaagcattctcttggctcacttgctttctacgacatgaaagaattcacatgagagagaaaccctatgagtgtcaacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccgtatggatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaaaccttaagtaatttcagtttctttccagtacagtcatcccttgatacctgctgggtattggttccagcactccgtgagccatgtccagtcccttttataaaatgacatatttgtatgtaacttacccacatcctcttgtatactctcaattatgtctagattacttaaaatacctcatgcattgtaaaagctatgcaaatagttgttctattgtattgtttagggactcatgataaggaaaagagtctatgtattttcagtatagatgcagtaattgtcagcctatcaacatagtatagtcagccagaacattaaagtttctttgtttcaactctc

SEQ ID NO: 400778 - DNA, 2399 bp, Homo sapiens
gccagcttccaaatattctctgcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagccttcagttaccacaactcacttcaaacacatgagaggcttcacactggaaagaaaccatataattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgagagaacgcacactggagagaaaccatatgaatgtaagcagtgttctaaagccttttctttttacagttcctatctaagacatgaaagaacacatactggggagaaactgtatgaatgtaaacagtgttctaaagccttccctgattacagttcttgtctaagacatgaaagaactcacactggaaagaaaccctatacatgtaaacaatgtgggaaagccttcagtgcttccacttcccttcgaagacacgaaacaactcacactgatgagaaaccctatgcatgtcagcaatgtgggaaagcgtttcatcatctgggaagctttcaaagacacatggtaatgcacacgagagatggacctcataagtgtaagatatgtggaaaaggctttgattgtcctagttcactgaaaagtcatgaaagaactcacactggagagaaactctatgaatgcaagcagtgtgggaaagcgttatctcatagctcaagctttcgaagacacatgacaatgcacactggagatggacctcacaaatgcaagatatgtgggaaagcctttgtttatcccagtgtatttcaaaggcatgaaaagactcacactgcagagaaaccctataaatgtaaacaatgtggcaaagcctaccgtatttccagttctcttcgaaggcatgaaacaactcatactggagagaaaccctataaatgcaaatgtgggaaagcctttattgatttctattcctttcaaaatcacaaaacaactcatgctggagagaagccatatgagtgtaaggaatgtgggaaagcattcagttgtttccaatacctttctcaacatagaaggactcacacaggagagaaaccttatgagtgtaacacatgtaagaaagccttcagtcattttggtaacttaaaagtacatgaaagaattcactctggagagaagccgtatgaatgtaaggaatgtgggaaagcattctcttggctcacttgctttctacgacatgaaagaattcacatgagagagaaaccctatgagtgtcaacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccgtatggatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaaaccttaagtaatttcagtttctttccagtacagtcatcccttgatacctgctgggtattggttccagcactccgtgagccatgtccagtcccttttataaaatgacatatttgtatgtaacttacccacatcctcttgtatactctcaattatgtctagattacttaaaatacctcatgcattgtaaaagctatgcaaatagttgttctattgtattgtttagggactcatgataaggaaaagagtctatgtattttcagtatagatgcagtaattgtcagcctatcaacatagtatagtcagccagaacattaaagtttctttgtttcaactctc

SEQ ID NO: 400779 - DNA, 2954 bp, Homo sapiens
cacctgcgctgggcgctcggtgctcggctctgtagctaagagacgacctggaagttccgtggcagcctgtgtcccgcgggaacccgcattggcagcgggagccgtccggaggcctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagccttcagttaccacaactcacttcaaacacatgagaggcttcacactggaaagaaaccatataattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgagagaacgcacactggagagaaaccatatgaatgtaagcagtgttctaaagccttttctttttacagttcctatctaagacatgaaagaacacatactggggagaaactgtatgaatgtaaacagtgttctaaagccttccctgattacagttcttgtctaagacatgaaagaactcacactggaaagaaaccctatacatgtaaacaatgtgggaaagccttcagtgcttccacttcccttcgaagacacgaaacaactcacactgatgagaaaccctatgcatgtcagcaatgtgggaaagcgtttcatcatctgggaagctttcaaagacacatggtaatgcacacgagagatggacctcataagtgtaagatatgtggaaaaggctttgattgtcctagttcactgaaaagtcatgaaagaactcacactggagagaaactctatgaatgcaagcagtgtgggaaagcgttatctcatagctcaagctttcgaagacacatgacaatgcacactggagatggacctcacaaatgcaagatatgtgggaaagcctttgtttatcccagtgtatttcaaaggcatgaaaagactcacactgcagagaaaccctataaatgtaaacaatgtggcaaagcctaccgtatttccagttctcttcgaaggcatgaaacaactcatactggagagaaaccctataaatgcaaatgtgggaaagcctttattgatttctattcctttcaaaatcacaaaacaactcatgctggagagaagccatatgagtgtaaggaatgtgggaaagcattcagttgtttccaatacctttctcaacatagaaggactcacacaggagagaaaccttatgagtgtaacacatgtaagaaagccttcagtcattttggtaacttaaaagtacatgaaagaattcactctggagagaagccgtatgaatgtaaggaatgtgggaaagcattctcttggctcacttgctttctacgacatgaaagaattcacatgagagagaaaccctatgagtgtcaacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccgtatggatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaaaccttaagtaatttcagtttctttccagtacagtcatcccttgatacctgctgggtattggttccagcactccgtgagccatgtccagtcccttttataaaatgacatatttgtatgtaacttacccacatcctcttgtatactctcaattatgtctagattacttaaaatacctcatgcattgtaaaagctatgcaaatagttgttctattgtattgtttagggactcatgataaggaaaagagtctatgtattttcagtatagatgcagtaattgtcagcctatcaacatagtatagtcagccagaacattaaagtttctttgtttcaactctcacatattgcttttgtttaatgtgttaacacttaccaaaaccctgggtcttctctcttgataacccaagtatagtgattataacgatgatgattctgtggtgcccagtgttttgatgtgttgagatgactagatgtatggcattgtgggtaagtagtgagacatcaggttaacttgaatcttgacaggccatcaggactatcatctatgttggaagaaccaacttgtgattatagatgtggactcatttgaggaggctatgtaatactaatgttaggatctgtttggcttgagggctgaagatctgtaaccattgaatgttccatcttctttgcagatgcttagttataggaagctagttcttcttttcctttgcttcattaaaaaaaaaatcttgcagtgtttataggcatgttgttatttctcgggtggagtgaa

SEQ ID NO: 400780 - DNA, 2518 bp, Homo sapiens
cacctgcgctgggcgctcggtgctcggctctgtagctaagagacgacctggaagttccgtggcagcctgtgtcccgcgggaacccgcattggcagcgggagccgtccggaggcctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtaggaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccatatgaaagccgtatgagtggagaagtcatcatgggtcattcatcccttaattgttacatcagagttggtgctgggcacaaaccatatgagtatcatgaatgtggagagaagccagatacgcataaacaacgtgggaaagccttcagttaccacaactcacttcaaacacatgagaggcttcacactggaaagaaaccatataattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgagagaacgcacactggagagaaaccatatgaatgtaagcagtgttctaaagccttttctttttacagttcctatctaagacatgaaagaacacatactggggagaaactgtatgaatgtaaacagtgttctaaagccttccctgattacagttcttgtctaagacatgaaagaactcacactggaaagaaaccctatacatgtaaacaatgtgggaaagccttcagtgcttccacttcccttcgaagacacgaaacaactcacactgatgagaaaccctatgcatgtcagcaatgtgggaaagcgtttcatcatctgggaagctttcaaagacacatggtaatgcacacgagagatggacctcataagtgtaagatatgtggaaaaggctttgattgtcctagttcactgaaaagtcatgaaagaactcacactggagagaaactctatgaatgcaagcagtgtgggaaagcgttatctcatagctcaagctttcgaagacacatgacaatgcacactggagatggacctcacaaatgcaagatatgtgggaaagcctttgtttatcccagtgtatttcaaaggcatgaaaagactcacactgcagagaaaccctataaatgtaaacaatgtggcaaagcctaccgtatttccagttctcttcgaaggcatgaaacaactcatactggagagaaaccctataaatgcaaatgtgggaaagcctttattgatttctattcctttcaaaatcacaaaacaactcatgctggagagaagccatatgagtgtaaggaatgtgggaaagcattcagttgtttccaatacctttctcaacatagaaggactcacacaggagagaaaccttatgagtgtaacacatgtaagaaagccttcagtcattttggtaacttaaaagtacatgaaagaattcactctggagagaagccgtatgaatgtaaggaatgtgggaaagcattctcttggctcacttgctttctacgacatgaaagaattcacatgagagagaaaccctatgagtgtcaacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccgtatggatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaaaccttaagtaatttcagtttctttccagtacagtcatcccttgatacctgctgggtattggttccagcactccgtgagccatgtccagtcccttttataaaatgacatatttgtatgtaacttacccacatcctcttgtatactctcaattatgtctagattacttaaaatacctcatgcattgtaaaagctatgcaaatagttgttctattgtattgtttagggactcatgataaggaaaagagtctatgtattttcagtatagatgcagtaattgtcagcctatcaacatagtatagtcagccagaacattaaagtttctttgtttcaactctc

SEQ ID NO: 400781 - DNA, 274 bp, Homo sapiens
gcttggagggaaagtcattgtttctttttgggatataattgatttgcatgtctatgaacaattatttgcattactatcaattttccacatgttagccaaaatatctacagtagtgttaaacagctcggagaaaagtctctgatccctaaggtccagatcatccgagggacaccctcatccattgagaggatgcccagtaatatttttgcttattccaaagtcttgtatttttccttacattgataattaatgctggattctggaacacttcaaa

SEQ ID NO: 400782 - DNA, 543 bp, Homo sapiens
ccacacacccatcccctagctactgagaataggggctgctaatggctcagaggttcatccctcattgggaaatgcatgacccaaggcacatcccctcctgggggagagccttagtcaatgactggctgatgggggatgcaaaggcccagctctctcacagtaggacagctctggagggccatcccagctccagagttccctgtagaattaactgaggtctccatggccagcacattgtggggcagctactccctctgccccgtcctgcctcccttgcccccttacaagtacatctcccaagaacactcctaattaatgttctgcgtgcagctctctatctcagagtctgtttccagggagcccaacctcagacatctcccaatctcaggctgagatactgggaaacacaaatgatactgactcagtcccctgactcgagggacccaaacagttacacagtgatctgccaatcaacagttgagcctttgactggtcttcaggttggttgtttccaacctgttccctctcactgggattaaagga

SEQ ID NO: 400783 - DNA, 1947 bp, Homo sapiens
taattttgccctaggtctggccaggaggcctcacatccagagacctgcccccgctcttgcagtgccagggccatggggctccggagccaccacctcagcctgggccttctgcttctgtttctactccctgcagagtgcctgggagctgagggccggctggctctcaagctgttccgtgacctctttgccaactacacaagtgccctgagacctgtggcagacacagaccagactctgaatgtgaccctggaggtgacactgtcccagatcatcgacatggatgaacggaaccaggtgctgaccctgtatctgtggatacggcaggagtggacagatgcctacctacgatgggaccccaatgcctatggtggcctggatgccatccgcatccccagcagtcttgtgtggcggccagacatcgtactctataacaaagccgacgcgcagcctccaggttccgccagcaccaacgtggtcctgcgccacgatggcgccgtgcgctgggacgcgccggccatcacgcgcagctcgtgccgcgtggatgtagcagccttcccgttcgacgcccagcactgcggcctgacgttcggctcctggactcacggcgggcaccaactggatgtgcggccgcgcggcgctgcagccagcctggcggacttcgtggagaacgtggagtggcgcgtgctgggcatgccggcgcggcggcgcgtgctcacctacggctgctgctccgagccctaccccgacgtcaccttcacgctgctgctgcgccgccgcgccgccgcctacgtgtgcaacctgctgctgccctgcgtgctcatctcgctgcttgcgccgctcgccttccacctgcctgccgactcaggcgagaaggtgtcgctgggcgtcaccgtgctgctggcgctcaccgtcttccagttgctgctggccgagagcatgccaccggccgagagcgtgccgctcatcgggaagtactacatggccactatgaccatggtcacattctcaacagcactcaccatccttatcatgaacctgcattactgtggtcccagtgtccgcccagtgccagcctgggctagggccctcctgctgggacacctggcacggggcctgtgcgtgcgggaaagaggggagccctgtgggcagtccaggccacctgagttatctcctagcccccagtcgcctgaaggaggggctggccccccagcgggcccttgccacgagccacgatgtctgtgccgccaggaagccctactgcaccacgtagccaccattgccaataccttccgcagccaccgagctgcccagcgctgccatgaggactggaagcgcctggcccgtgtgatggaccgcttcttcctggccatcttcttctccatggccctggtcatgagcctcctggtgctggtgcaggccctgtgagggctgggactaagtcacagggatctgctgcagccacagctcctccagaaagggacagccacggccaagtggttgctggtctttgggccagccagtctctccccactgctcctaagatcctgagacacttgacttcacaatccacaagggagcactcattgtctacacaccctaactaaaggaagtccagagcctgccactcccctaattccaaaaaaaagaggaactctacaaaggccaagatcacagagtacagtcttggagggacagaattgtttgtgctgggtattggagctctcagtggggagcacatgggttataatgagaaactgaactgtactgctgcatttcctgtcttccttcctaggtggctgctttgcagggctttggctgttacctttccctgctgaggggctcagggaaaagggtcggggattctcagtcgagtttccagagcaggaggccctacagacatttcgccccaaatccctgactcaataaagtaagcgtgtacctagcacc

SEQ ID NO: 400784 - DNA, 1012 bp, Homo sapiens
aaaaggcgggaaaacgtggaaagagggtaaaatctgtttccagattcctctggcacctactggtgccctttggataagcaagtgctgactccagcaaggaagggctgatgtcctgccatcaggccagcagacgctggggccaggtgctcccctgcgtcgtgagtgtctcgaacttaacgagcctcaatattctggggagaagttttggtttctttcagcccctgggggtctgccctgggctcccggcctccggggctgctcctcaggctggacagcctaggtgagccctgccccgcctgcccccagagccgacgcgcagcctccaggttccgccagcaccaacgtggtcctgcgccacgatggcgccgtgcgctgggacgcgccggccatcacgcgcagctcgtgccgcgtggatgtagcagccttcccgttcgacgcccagcactgcggcctgacgttcggctcctggactcacggcgggcaccaactggatgtgcggccgcgcggcgctgcagccagcctggcggacttcgtggagaacgtggagtggcgcgtgctgggcatgccggcgcggcggcgcgtgctcacctacggctgctgctccgagccctaccccgacgtcaccttcacgctgctgctgcgccgccgcgccgccgcctacgtgtgcaacctgctgctgccctgcgtgctcatctcgctgcttgcgccgctcgccttccacctgcctgccgactcaggcgagaaggtgtcgctgggcgtcaccgtgctgctggcgctcaccgtcttccagttgctgctggccgagagcatgccaccggccgagagcgtgccgctcatcggtgagcagcgggggcgcggggggacctgacgatgcgctggggtccccccagggcggggccgcgacagggcctgggtctgcggaacggccccactgcagaaagtgagaggggggcgtcctgggaacgtgccctcattttaagactgaggggaaaggattagctccttccaggga

SEQ ID NO: 400785 - DNA, 1285 bp, Homo sapiens
gattcgtatcttgccccagctcatgcccgtcgttatttgagagcgggactgtcctggattgtgtatgagtgcagcctccagcagtgacgggagcaattagagagcagtagcttccgatgacccacgtgtaggaatgaaggatggggagaactcggcccttacctccttcctgcttccatccatggggcttggagggtctggagagcttcatggtgggcttatttccatttgtgcagaggtggctgggaagctcaggaaccacaggcttttgttttgagtcaattggctttctctctctcttgcagggaagtactacatggccactatgaccatggtcacattctcaacagcactcaccatccttatcatgaacctgcattactgtggtcccagtgtccgcccagtgccagcctgggctagggccctcctgctgggacacctggcacggggcctgtgcgtgcgggaaagaggggagccctgtgggcagtccaggccacctgagttatctcctagcccccagtcgcctgaaggaggggctggccccccagcgggcccttgccacgagccacgatgtctgtgccgccaggaagccctactgcaccacgtagccaccattgccaataccttccgcagccaccgagctgcccagcgctgccatgaggactggaagcgcctggcccgtgtgatggaccgcttcttcctggccatcttcttctccatggccctggtcatgagcctcctggtgctggtgcaggccctgtgagggctgggactaagtcacagggatctgctgcagccacagctcctccagaaagggacagccacggccaagtggttgctggtctttgggccagccagtctctccccactgctcctaagatcctgagacacttgacttcacaatccacaagggagcactcattgtctacacaccctaactaaaggaagtccagagcctgccactcccctaattccaaaaaaaagaggaactctacaaaggccaagatcacagagtacagtcttggagggacagaattgtttgtgctgggtattggagctctcagtggggagcacatgggttataatgagaaactgaactgtactgctgcatttcctgtcttccttcctaggtggctgctttgcagggctttggctgttacctttccctgctgaggggctcagggaaaagggtcggggattctcagtcgagtttccagagcaggaggccctacagacatttcgccccaaatccctgactcaataaagtaagcgtgtacctagcacc

SEQ ID NO: 400786 - DNA, 1206 bp, Homo sapiens
taattttgccctaggtctggccaggaggcctcacatccagagacctgcccccgctcttgcagtgccagggccatggggctccggagccaccacctcagcctgggccttctgcttctgtttctactccctgcagagtgcctgggagctgagggccggctggctctcaagctgttccgtgacctctttgccaactacacaagtgccctgagacctgtggcagacacagaccagactctgaatgtgaccctggaggtgacactgtcccagatcatcgacatggtgcgttgtggtggtggtacagctgtggagtcttacctgtcacagtgtcaagaaatgaaggggatgaacggaaccaggtgctgaccctgtatctgtggatacggcaggagtggacagatgcctacctacgatgggaccccaatgcctatggtggcctggatgccatccgcatccccagcagtcttgtgtggcggccagacatcgtactctataacaagtactgcctatctgggcccctcctctctcttacccctctctagacttgcccttagctgtgggggtgtagtgatcccctctccctaccacataacctggttgccacgctgccctggaagcttttccccaggacccttctaagctgccaggcactcagcccctccatggcacccccactttaggctatcccaggccagcccaggctgaacgtctcctcggaacctactgtgtggtccagggcagttgtctgaatcacaagggcctctctagggcacacttttagctctaagtctctcagggctcccccaagagcctgtgtaagggtctctttcctccaggacatagccctctggaacactgctttatgtctccttgaccagttccgtgtctcccagccagcacatagctctgcatattttctctggggcccttctacaagttttgcagatgtcccccaagggaagtcactgtgtgtcccggagctacctctgggttctgcagaggcctttttatacatcctctggctacgtctgtgtcccttctggcccttcaggcaccaccccttccaggcctcgaaaggcagcgggtctctctaggtgcactccaccctctgtgttgctttgttctgaaaacaagaatcaaattaacgaaaaaaaaacaagcacatgggttataatgagaaaccgtcgattcgagggaatcctctgggta

SEQ ID NO: 400787 - DNA, 1819 bp, Homo sapiens
aaaaggcgggaaaacgtggaaagagggtaaaatctgtttccagattcctctggcacctactggtgccctttggataagcaagtgctgactccagcaaggaagggctgatgtcctgccatcaggccagcagacgctggggccaggtgctcccctgcgtcgtgagtgtctcgaacttaacgagcctcaatattctggggagaagttttggtttctttcagcccctgggggtctgccctgggctcccggcctccggggctgctcctcaggctggacagcctaggtgagccctgccccgcctgcccccagagccgacgcgcagcctccaggttccgccagcaccaacgtggtcctgcgccacgatggcgccgtgcgctgggacgcgccggccatcacgcgcagctcgtgccgcgtggatgtagcagccttcccgttcgacgcccagcactgcggcctgacgttcggctcctggactcacggcgggcaccaactggatgtgcggccgcgcggcgctgcagccagcctggcggacttcgtggagaacgtggagtggcgcgtgctgggcatgccggcgcggcggcgcgtgctcacctacggctgctgctccgagccctaccccgacgtcaccttcacgctgctgctgcgccgccgcgccgccgcctacgtgtgcaacctgctgctgccctgcgtgctcatctcgctgcttgcgccgctcgccttccacctgcctgccgactcaggcgagaaggtgtcgctgggcgtcaccgtgctgctggcgctcaccgtcttccagttgctgctggccgagagcatgccaccggccgagagcgtgccgctcatcgggaagtactacatggccactatgaccatggtcacattctcaacagcactcaccatccttatcatgaacctgcattactgtggtcccagtgtccgcccagtgccagcctgggctagggccctcctgctgggacacctggcacggggcctgtgcgtgcgggaaagaggggagccctgtgggcagtccaggccacctgagttatctcctagcccccagtcgcctgaaggaggggctggccccccagcgggcccttgccacgagccacgatgtctgtgccgccaggaagccctactgcaccacgtagccaccattgccaataccttccgcagccaccgagctgcccagcgctgccatgaggactggaagcgcctggcccgtgtgatggaccgcttcttcctggccatcttcttctccatggccctggtcatgagcctcctggtgctggtgcaggccctgtgagggctgggactaagtcacagggatctgctgcagccacagctcctccagaaagggacagccacggccaagtggttgctggtctttgggccagccagtctctccccactgctcctaagatcctgagacacttgacttcacaatccacaagggagcactcattgtctacacaccctaactaaaggaagtccagagcctgccactcccctaattccaaaaaaaagaggaactctacaaaggccaagatcacagagtacagtcttggagggacagaattgtttgtgctgggtattggagctctcagtggggagcacatgggttataatgagaaactgaactgtactgctgcatttcctgtcttccttcctaggtggctgctttgcagggctttggctgttacctttccctgctgaggggctcagggaaaagggtcggggattctcagtcgagtttccagagcaggaggccctacagacatttcgccccaaatccctgactcaataaagtaagcgtgtacctagcacc

SEQ ID NO: 400788 - DNA, 1215 bp, Homo sapiens
taattttgccctaggtctggccaggaggcctcacatccagagacctgcccccgctcttgcagtgccagggccatggggctccggagccaccacctcagcctgggccttctgcttctgtttctactccctgcagagtgcctgggagctgagggccggctggctctcaagctgttccgtgacctctttgccaactacacaagtgccctgagacctgtggcagacacagaccagactctgaatgtgaccctggaggtgacactgtcccagatcatcgacatggtgcgttgtggtggtggtacagctgtggagtcttacctgtcacagtgtcaagaaatgaaggggatgaacggaaccaggtgctgaccctgtatctgtggatacggcaggagtggacagatgcctacctacgatgggaccccaatgcctatggtggcctggatgccatccgcatccccagcagtcttgtgtggcggccagacatcgtactctataacaagtactgcctatctgggcccctcctctctcttacccctctctagacttgcccttagctgtgggggtgtagtgatcccctctccctaccacataacctggttgccacgctgccctggaagcttttccccaggacccttctaagctgccaggcactcagcccctccatggcacccccactttaggctatcccaggccagcccaggctgaacgtctcctcggaacctactgtgtggtccagggcagttgtctgaatcacaagggcctctctagggcacacttttagctctaagtctctcagggctcccccaagagcctgtgtaagggtctctttcctccaggacatagccctctggaacactgctttatgtctccttgaccagttccgtgtctcccagccagcacatagctctgcatattttctctggggcccttctacaagttttgcagatgtcccccaagggaagtcactgtgtgtcccggagctacctctgggttctgcagaggcctttttatacatcctctggctacgtctgtgtcccttctggcccttcaggcaccaccccttccaggcctcgaaaggcagcgggtctctctaggtgcactccaccctctgtgttgctttgttctgaaaacaagaatcaaattaacgaaaaaaaaacaagcacaagtttatttatttatttgagacacagcctgggcaagagagtgagacttcatctc

SEQ ID NO: 400789 - DNA, 519 bp, Homo sapiens
acagctttatgagacgagtctgttatctccatccccatttgatagatggggcatccctgtgggagctctgcccattccagaggtgccaggccattcactaatgggggcaggagccggtgagtaaatgccagtcttgtgctgtcacaggtggacgattcagagaggtgttctagaccattcagatctttctggaaccttctcagagaccagaagtatctcagacttgctatcagggaaccaaaactaaaacaaaagggaaacttgatactgggtcatcccctatagttctgtaccttgcctgggttaaaattgcactattttattagatgtgtgaccttgggccagtcacctgtctgtgcctgtttcctaatctgtaaaacggacataatgtcacctaattcacaggggtgttggaagagtgaagagagatggtgttaggtgaggtccttaaaacagtgcacaacgcattataagtgctcaataaatgtttgctgtttgattgcattttaaattgtaaca

SEQ ID NO: 400790 - DNA, 336 bp, Homo sapiens
atcacctcccacataaacgacttacactcaagtctcagacttgctatcagggaaccaaaactaaaacaaaagggaaacttgatactgggtcatcccctatagttctgtaccttgcctgggttaaaattgcactattttattagatgtgtgaccttgggccagtcacctgtctgtgcctgtttcctaatctgtaaaacggacataatgtcacctaattcacaggggtgttggaagagtgaagagagatggtgttaggtgaggtccttaaaacagtgcacaacgcattataagtgctcaataaatgtttgctgtttgattgcattttaaattgtaaca

SEQ ID NO: 400791 - DNA, 954 bp, Homo sapiens
ataactaataacaaaatagaagaattataacaatattctagcatcactactttgatgctttggggctattactaagtaaaataagggttacttgaagagaagcactgagataccatgacagttgacctgatcactgagatagctaagtgactactgtgtagatagagcatgcagtgtggatacactggaaaaagagcagattcacatcccaggtgagaaggagcaggacagtgcaagatttcaccacactgcgcagaatgaaattgacaagatgatcctaaaatttatctagaaacacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagcccttgagaaataaaccttatatatatggtcaactgatttttgacaataatgacaagaaaattcaataggaaaagaagttatttcaacaaatggtactgggacaactggatacacacatgcaaaaggatgaagttggaaccttacctcataccatatgcaaaaattaatgctaaatgagtcatagacctatatataagaattagaactataaaacttatggaagaaaatataggtgtaagtctttgtgattttggattacacaatggtttcctagaatgactcttaagcacaagcaaccaaatcaataagttggatttcatcaaaattgaaaacttttgtgcctcaaaggacattatcaagacaatgagaagagaacacatagaagaacacacttacaaatcatatatctgatacatatctgctttccaaaataagtaaaaacttttataactcaataataaaaacacaagtaacccagtttaaaaatgggcaaaaacaaagt

SEQ ID NO: 400792 - DNA, 856 bp, Homo sapiens
tagccatttaaagagaacacatggaagtaaaccaagaacccagccaatatccccaggtaagagatagagcatgcagtgtggatacactggaaaaagagcagattcacatcccaggtgagaaggagcaggacagtgcaagatttcaccacactgcgcagaatgaaattgacaagatgatcctaaaatttatctagaaacacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagcccttgagaaataaaccttatatatatggtcaactgatttttgacaataatgacaagaaaattcaataggaaaagaagttatttcaacaaatggtactgggacaactggatacacacatgcaaaaggatgaagttggaaccttacctcataccatatgcaaaaattaatgctaaatgagtcatagacctatatataagaattagaactataaaacttatggaagaaaatataggtgtaagtctttgtgattttggattacacaatggtttcctagaatgactcttaagcacaagcaaccaaatcaataagttggatttcatcaaaattgaaaacttttgtgcctcaaaggacattatcaagacaatgagaagagaacacatagaagaacacacttacaaatcatatatctgatacatatctgctttccaaaataagtaaaaacttttataactcaataataaaaacacaagtaacccagtttaaaaatgggcaaaaacaaagt

SEQ ID NO: 400793 - DNA, 714 bp, Homo sapiens
  misc_feature (14)..(14): n is a, c, g, or t
  misc_feature (38)..(38): n is a, c, g, or t
ggggtttgttggtngcaaagaaacacccagttgcttgnagaaattatatagcacccacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagcccttgagaaataaaccttatatatatggtcaactgatttttgacaataatgacaagaaaattcaataggaaaagaagttatttcaacaaatggtactgggacaactggatacacacatgcaaaaggatgaagttggaaccttacctcataccatatgcaaaaattaatgctaaatgagtcatagacctatatataagaattagaactataaaacttatggaagaaaatataggtgtaagtctttgtgattttggattacacaatggtttcctagaatgactcttaagcacaagcaaccaaatcaataagttggatttcatcaaaattgaaaacttttgtgcctcaaaggacattatcaagacaatgagaagagaacacatagaagaacacacttacaaatcatatatctgatacatatctgctttccaaaataagtaaaaacttttataactcaataataaaaacacaagtaacccagtttaaaaatgggcaaaaacaaagt

SEQ ID NO: 400794 - DNA, 455 bp, Homo sapiens
ttctatacctaatttggtaagagtttgtaataatgaaaagatgctgaattttgtgaaatactttttctgcagctattgagatgatcatatgattcctgtccttcattctgttaacgtgatatagcacctttattgatttggctatgttaaaacactcttgcatcccaggaataaatcccacttgatcatgctgtatggtccttttaatgtgctgttgaatttggtttgctagcattttgttgaagattttctgcatctattttcaggagggttattggcttatagttttcttttttcatatatctttgtctggcattaatgttagcataatgctggctttgtaaaaataagtacagaagtgttctttcccattccatttttgggaaaggtttgagaaacagtattattaattcttctttagctgttgataaaattaaacagcaaagccatcaaat

SEQ ID NO: 400795 - DNA, 930 bp, Homo sapiens
tgcgcatcatgcatatgggggccagttgggagacagcctgtgctagcgtcattctgtgagtggcgagaataaaatgaattcagtaggttgtggtcagataataaaaacagtgacagccaaacagctaattttacatttggtgttttggctataggaatctctgttaggtacctgagccaggaagtactgttatgaaagcactgttttcatgggttggaggaggggagcagggagacttctagaaggcggttagaacagtccaggcaccctgtgatgaggacaaagacttctaacagctggaaaggcaagaaagtgactctgcaaatgactgtccaaaaatattggtcatcaagtttttatgatcatcttaatataaataactggcaaagatttcatttcaagccaattttcctgtaaatttagattttggataacagtcttaagtagctagttgtgtgcagtgggaaaaacaagatcaaagtagaagcaagaaactgaagtttaaaaatatttgtgatccagagtgattcagggatcagtacgatttaaactacacaaatgcaaagtaggaacgaaagattcttaaatgtggatagagtctccagtacaaggaatgcaacaaccccttccccctgaaaatagcatagagaccatctagtgtgtataccctggaaacacttcctggctatgtgggttaccggctttgtggtcttgagatggtcagtttctgcatctgtaaaacagaaagaataactgtgtgtgccatttagggttgctgtaaaagctaaatgaggtaatatatatagtgtgcttgtcatttagcaagtgctcaataaagtgtaactaataaagataaatccttttggactcaacttttttaagagaaagaaggaaatactaacaaataaaactcatatgagtagtccgaat

SEQ ID NO: 400796 - DNA, 547 bp, Homo sapiens
ccagatatcaaaggtgggttctctttaaactgacttaacaggattcttgctacaagccccagattgaggcctggtagagaggagggctcaaggccctagcaaaagtgtggtcaagatgagagtctttatcggtgattgggaattcttgcaaagctcagcagtttaatgacccctgtatggagatcatctgaagcatcaagaccaacttaactggcacccacccttatttattcacctggttgtttgtgcattcataaataataaaccttcagcagatactatcctgtgtgctggcaagggataaatattaatctcttgggattttcggtccctgttctcacccaactggtgtttaagaggtccctatgagtttcactttttaggcgggggaggagaggagagaagaaaaaatagacctcagatactccacaacaagccatgggggaacatcactgggagagcctgggcccaggcccagccagaagttaccattgaaagaaaaattactttgtacttggaaataaaacaagaaaaaggaaaactttgt

SEQ ID NO: 400797 - DNA, 373 bp, Homo sapiens
cttcttacaaagttacctacttttttccaaaaatctgaaaagatttagggaggagatcaatggaacatgtaatgtgttttctccagtctaaaacttaacagctgcataactaattttaagtacaaatcatgctcttgggttactgagagttactggtatatggttgtgattaaagttaaaactttatttatacctgtatctctaattttctttactgattttcagctttagtctactgaaaataccattacattttaagagaaaaaaaggtgaccaatatattattaagatataagaaaaagcctttttaaattttactgattatgaaatcaatagatgtttcattgtttaaaaataatctagaaaataccaa

SEQ ID NO: 400798 - DNA, 484 bp, Homo sapiens
cttctccctgctctgtttctgatacgtcttttaaaaatatttatacatgtcaggccgggtgcaatggctcacacctgtaatctcagctcttaaggaggcagaggcgggaggatagcttaaacccaggagttcgagacctgcctgggcaatatagcaagaccccgttctccacacaaaggaaaaaaaaagtattgttgggccaggcacggtggctcacgcctgtaatcccagcactttgggaggccgaggtgggcggataacctgaggtcaggagttcgagaccagtctgaccaacatggtgaaacctggtctgtacaaaaaaaaaaaaaatacaaaaattagctgggcatgatagcgggcgcccgtaatcccagctactgaggaggctgaggcaggagaattgcttgaacccaggaggcggaggttgcagtgagccgagatcacaccactgtactccagcctgggcaacagagtgggactccat

SEQ ID NO: 400799 - DNA, 402 bp, Homo sapiens
gctcagaaaaaccataaatgcctaaatcatatctctacgccaatttctctccacatctattatcatttagaggcagagaaaacaacattaactaatgtttctggccctctgatcctcatgacttgaggctcttaatagaaatgtaacgcaaagagggaaatagggaaaactagagataaaatatttccctaactaaatggctagcagacaatgtttcaactggaaaatctaagtaacacatcctccttaaaaaaaattaggatctcagatataggtcagctctgtactcttgatttgtttttcttgagaaggagtgtggctctctctctctctctctctctctctctctctctctctctctctctctctctctctctctctctctctctctctctctctctc

SEQ ID NO: 400800 - DNA, 444 bp, Homo sapiens
tgttgttgcttgatgagtattgtctctgctgtcttgatattctgaaggcatttttagtaatggtcttgaggaccattactaatatcataccaaatcagaccaaaataatgttcctgaaagctcgtgatgaaaaggatttgctaatccaaatagagacactagagggagctctcttccaggagactggctgcatctggaaatggccctagagggacaagaaagctttaaatgactggactcatagagtatttaatggaacatcatattggtcaacagtgcaagaagagggcttatactcttatgtaggaaagacttttaaatattccaattgctatggaagttgttgtttttaaagattcattgccagcagttctagtagccaagctaatattgaagaaagactcttgaatattccaattgctatggaagttgttgtttttaaag

SEQ ID NO: 400801 - DNA, 599 bp, Homo sapiens
aatgttcacaatccgtggctgtggacgtaagggctatcaagataagacgaggaagaggaagatggcattgataataaaggtagtgatacacgaaccataggattaactgcctcctcaagtccatcatgtaaataaggtgctatgtataccaacttctcaccacctttgtttttctgttaggtctacctggccatggtagacttaaccatgaccatataaatgtaaatgaaggaaacactccaattaaaggcagcaattatcagactggattttaaaaaagcaagatctgtattgtctgcattttaaatatattttataaatcttggtaagaagttactaactcatttgcactctgtagccatctacagccatatacatacactttaatttaaaagacataattttatctcaacaagaaaaaatgttatagaagggtactttttcttccatgggcagtggcttgatacattaggtaagtttactttgtggtctgtgggctagtgtctctatatatgcacaagaaggtgcagtgggagagggggcattttcctgtgttcacccagtacacagtatgctaccatattgtgatatgaggatga

SEQ ID NO: 400802 - DNA, 489 bp, Homo sapiens
ctctgcatttactaaactcttcattgcaataacactgtctcagtaaatcagcttttctgggcaggggcaagatgaacccattaggcaattatgctggtgctgggagcagcatctctgtcccatcttttctataagctctgtcacaaagaagctaatacttttagaatatgtacctcaagttagcctctgagggttgaaaatgaatgatttttaagccaaactaattttaagcacccacaaccgactgaatggactcctgggattaaaggtgtgagccaccacgcccagcctcacctggataatttttttaaaaacattttttgtagaaatggagctttgctatgttggccaggcttggcataattattttataaattgtatatacatatgtataattgtgtgtactagtaatagtgaaaattgacattttaaaaagcagtacaatttacaacagagtaattaaatataaaatacttaggaataaaatat

SEQ ID NO: 400803 - DNA, 635 bp, Homo sapiens
agtctgagtatcagccatgagaacatcccaagcctattaaatggcaagtaaatctgtaaatggccaaatgtaatatattgcctgttagttaatgctgggaagaaaatggcttttgtttataaagtaattttagtttgtattactttaccatcgtttttcatgggttggttattatctttattttacaaatatgaaaatagtctgagataaatcagacagcttatccaatatcatgcatcctaattcagttataatctgcattttcatcagcatcctcagctttatacaataatttagcttcacattattgaccctgactcatcaatgaaaggttacattatgttgcagatgttctactttttcaaaaggcatggaggttgatagtacaaaggcctacatctgtgggaacatttctagccactattctttttcacgttctctatgaagtagagatgccggtgaggctgcagataaaagggaacacttatacactgttagtgggaatctagattagtcgagccactgtggaaagcagtttggagatttttccaagaacttagaactgccattcgacccagcaatcccattactgggtatatacccaaaggaaaataaactgttttaccgaaaagaca

SEQ ID NO: 400804 - DNA, 347 bp, Homo sapiens
tggattctcaaagaattcatgaaaatgttcacaatagagtcttcttatgcatctgttttccctacagcattcaattcaagcacatgaaatatcaggttgtacaagaagcatggcaccagcatctgcatctgatgaggacctcagggtgcttccacttgtggcagaagaaggggagctagcatgtgcagatgccacatggcgagagataaaggaaaggaaagaggaggaaggttccaggctctttttaacaatcggacctcacaggaactaatagtgtgagaagatgtttaacatattctaataagaaagatattcctaataaactgccgtgagataactgctatatt

SEQ ID NO: 400805 - DNA, 357 bp, Homo sapiens
tttatgtatgggatgcagcagggagcctagatgctagtgagaagtgacagacaggaaacatctactcaaataaataataccaaaggacagattaaattcccaacaatcacaacttttaagaaaatatgattgatctaatatgaaaatttgcagcaaatttttgaaaaatggaacatcttatttgtattataaaatatttttaaaacttataagggatatgttatagggtttctttaaagattggtctttcccactgagttttaaaaacatgatttaattgggaaaaacatagcttttcagaaatattgctgtttcccctctatccagtagatgctggtctacctactaaatatttct

SEQ ID NO: 400806 - DNA, 775 bp, Homo sapiens
gaagaaagtcctcggaagctgcaaagctctggatagatgtgaaagtttgtatttgaggaaatataaggaacatcaggatgttgtcctagcttagagaaagatcatgctaatcaaagactcatggttaggaggtacattgggagtggaattgacaggcttggtatgtgactgtatgtaaaggctgaggggaaggaggcagcatactggtttctgatttgtgggcttgggtggccagtggtttcatgggctgagatgggtggtttgggggtctgtaccagttctgtggggggcagtgatgtttgtggacagttgagcccctaggacatcccactggatatggacaactgcatgaacaggtaggacataggtccgagctggagacagatttggcagccatcagcgtgcgctggtggtggaaaccccaggaagctaaaatcccccaggggaagggtgtacaaaaaaggaaaagctgtagaaggatgtgcccatggacccttgggatctgccctgtatccatacactgcatatgtgggcgacgctcagcaggatgtctggatggactgtgccaggtccctgaatggtacactacagctcctgagaaggtagcctcatgcctgtcttctttgatcctagaaaaaccaaacaggacatccagatcatgaaagatggcaaatgctgatcccacaggagcacctcaagccatgaagtgtcagctggagaacagtggtgggcatggagaggatatgacatgaaataaaagatccagcccaactga

SEQ ID NO: 400807 - DNA, 1114 bp, Homo sapiens
gaatggattggaggaggtgagactggaggcagggaaacagcatgagtaatgaagaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaagatccagcccaactgaaaaaaaacaaaaaaaaaaaaaaaaaaaaagggggggagcgacacaaaagagataccacaccaggggggcccaaagaataaaggagacaccaaagatatgtgggacaaagggggccccaaaaaggcgaaacaggtaaaaacaacaaagagcacgagtgccacgccagaaacaaacaaccacgttgaagacaccgcgcacaaacggcaacaacgcggggcaacccctgagcaacaggacaccaatacaaagaggggagaggaacacccacacctccgaccaaaacacaccaaacaagacaaccataaaaaacacccccaaagaagaccacatatacaaaggaaaccaagagtgaccaccaccgggctccccacacaacaaacacacaacaaaagacatagcaccccccaacaaacactcgagtacaaccggacaacatacagacagcaaacaacaaacacacaacgagggagcacccaaggaggacaaaacaacgaaagagaagccaacacagcagcaaccaacaccaacaccacaaccacaaccgcccgaaacaccaccacaagaacagagaacagaacactaacagaaagacagaacgccacaacagcgaaagaagaagccagccggagaaggggaccacacagaacacacaagcacaaaaaacaaggacgcgcaggacgacgacaaaccacacaaagaacagacagagaaacaaacagcgagacaacgaccaaggagccagacgaaaaaataaaacgccagac

SEQ ID NO: 400808 - DNA, 402 bp, Homo sapiens
ggcgcaggccccagccagctcaggctacactatcccaggatcagcatggccgtccgccagtgggtaatcgccctggccttggctgccctccttgttgtggacagggaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaagatccagcccaactga

SEQ ID NO: 400809 - DNA, 548 bp, Homo sapiens
ttctgcaaatgggaggtactggaaagaacgtgagggcaggaggagagatatgccagggtatttattgccctagctccccctctgccagaccacaggtagaatagcaagaagtctacatcctgatgatcctgggcattgggagctcacctcaccttctctggactctggagggcacacacatatggtccctgctgggggatgcttcgcacacagaccgtcttccagaggcaggggcagggaaactgctgtcagaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaagatccagcccaactga

SEQ ID NO: 400810 - DNA, 703 bp, Homo sapiens
gagagggagtctcgttctgttgcccaggctggagtgcagtggcacgatctcggctcgttgcaacctctgcctcccggtttcaagcaattctcctgcctcagcctcccgagtagctggaactgcaggtgcgcgccaccatgcctggctaatttttgtatttttagtagagatggggtttggttatgttggccaggctggtcttgaactcctgacctcgtgatctgcccaccttggtctcccaaagtgctgggattataggcgtgagccaccgcgcctggccaagaatcttttacatcgtagttttgatcagaattccaaagaacaaggttaacaaaaatgtggcttcctctatctgtatccctgtatttcttactttacatcatgatttttctccacatgttttataacagatccctgaggcagctgtataaatgggttttacatgaaaataaaatgaaatactttgagtaattctggcgaccgcatcagagaaatgagggattcaactgagacagctcacgtgatcagtcccttcctgtgtcctgtgccaagggccctcggtgcctcttcttttggaagctcattttctaattgtgaccaaggaaactcctgtatatttggttagcaaagacagccagtggagaccctgaaaggaagataagtgggaaagaaggaacagagcagagtaaatgcaaaaaaggac

SEQ ID NO: 400811 - DNA, 487 bp, Homo sapiens
tcaagaaatctttatggagcacctgctatggtccaggcccagtactaaatgctggaaagagagagatgagaaacttattctctgcttttaagcagatcaaaacctattaaatgaagacatgtaaatttgaaaaactacaaaacaagtattttaagtgcaattatagaaatgtataacaaggtatgggagaagaaaattctttttgtggagtgagcagttgtacagctcgaggggccaacatacacataaattaccacgtgatcagtgccctgtagagctgtgcagcatgaagggcctgggtggaaattggccaaggtggaatctggacttggcttcccacactcctggctcttctgtttctaatgtgccttcacattgctcttagagctatcatcttaaatgttaatacaatcaccttattgcctcgttttatatcatctactggctccccgttactcacagaataaaataaaaacttcttaaccat

SEQ ID NO: 400812 - DNA, 175 bp, Homo sapiens
caaactacttatgattaaatattcaaaacaacctaacaacccaattctcaaaagaaaagctccattaaaagcaagataaacataaaacttatgaaatggtatttttccgcactgtttccacacccttaagcagtgtggttacgacctacaaaatagagatatccaatagccaggg

SEQ ID NO: 400813 - DNA, 486 bp, Homo sapiens
cttagtaaataacgtctaatctcatggttgaaaatatcaataagctaatgacttcaaattcatctctccagtctagaatcttcctctgaactaatccagactcatttatcctaaggatattcaacatgtttttgaggcctctcagagttaacacatatcacactgcagacctgctgttgtctcagtaagctgcaccttctacagtcttctccacctccataaaaaacaaatccatactttaacttccgcagacccagatatgtgaatcattcttgattgtctttgtttctcacatcccctatcagctatttgaatattcaaaaatattctcagaataagtccttcatgatttccactcctcgagacacaattatcttctatcctgattgctgggggcctgtactaactggtgttcctgcttccattcttttttttctttttgagatggaatcttgctctgtcaccaggctggagtgcagtggcatg

SEQ ID NO: 400814 - DNA, 494 bp, Homo sapiens
caccattcattcctccctcccattcataaggccagaggtagccagtccagaactgagagggcccttccaaaggtccaggacccagactccttctccccagttgctgctggactaatttcccttcctgaagttgttttataggccaagatggatgctggagctctagccaacacagctaccttccagccaacaggaagttactcaagggcacttcccagaagctccacaatcttgggatcatatccaatgtgctgccaggaattagtcacacgaccacacctaggctgggaatacagtcttcaccctgggtagccacacatccagctaaaacatgcaggttgtatcattaggaaggaggtgaggctggatgccaggagaggccgtcagactctgtggggcctggccactgactcctccccacagcaaagttcctcctttcgaaacttgccctcctctcaaccaaaggaggtctctgtctttgcaactctgagaaa

SEQ ID NO: 400815 - DNA, 206 bp, Homo sapiens
actcttgaggctctgaagaatttctgtgctttccaattcaccaggagttacaaggtcctgaaaaccacaactgtgttacatcctttaatagataaagcaaagctgattttaatgtgaatatactttatagttatttctattcctgttaatttttgtttgcttgtaatacacatttttatgtaactgggagtaaggaacatcttagg

SEQ ID NO: 400816 - DNA, 482 bp, Homo sapiens
  misc_feature (430)..(430): n is a, c, g, or t
  misc_feature (466)..(466): n is a, c, g, or t
cattttaatacaagttcctataggtggaattgctgtgcccagagtatacaatgtataaaaatttttgtagtgtcagtttgccctactgaaagattatacattgtttccagcactgtaggtgagggtccttttctttccaccctaacaaacaacaaatattaattacctcaagaaacatttatctagttctttgtttttgaaacggagtcccctctgttgcccaggagtgcagtggtgccataatttagtttagttttattttggttttattagtttatgccatacttttagtttctaataggcttaaaaccttagtctttgacttgtccttttcccctttgttcagttagttatagtcccccccaaccccaagataggtttttactctgtcacctaggctaggctggagtgcagtgagctgagatcgtgngttgcactccagcttgggtgacagagtgagactccntctcaaaaaaaaaaaa

SEQ ID NO: 400817 - DNA, 950 bp, Homo sapiens
cattttaatacaagttcctataggtggaattgctgtgcccagagtatacaatgtataaaaatttttgtagtgtcagtttgccctactgaaagattatacattgtttccagcactgtaggtgagggtccttttctttccaccctaacaaacaacaaatattaattacctcaagaaacatttatctagttctttgtttttgaaacggagtcccctctgttgcccaggagtgcagtggtgccataatttagtttagttttattttggttttattagtttatgccatacttttagtttctaataggcttaaaaccttagtctttgacttgtccttttcccctttgttcagttagttatagtcccccccaaccccaagataggtttttactctgtcacctaggctaggctggagtgcagtggtacaatcatagctcactgcagcctccatgtcctgggctcaagtgatccttccaccttaccaagactacagtgccaccacgcccagtgaattttccttttgattttttgtagagatgaggtcttgctatgttgctcaggcttgagctcaagggatcctcctgccttggcctcccaaagtgctaggattataggcaagagtctgcacccagcctataaagtcttgctaattttataatgttaccattttttccctctccttataaatatgtactttttaaattatcaaaaaattggaagaggacggacaggaaataaagagataatcctgttaacattttagagtatatcccattagaattttttctttgtatgcaagtacatgtacatatatttagtgcagccctattagttttacaaagtgatgcctgtgtttcttttttcctttatttctactgctagtgtctaaacttttttttttttctttttttgagacagagtctcgctctgtggcccaggttggagtgcaatggcgt

SEQ ID NO: 400818 - DNA, 345 bp, Homo sapiens
tggggagatgaaaaaccaatacaaatacagcaattactatatgccagatattgttctaattgtttccaatatatcaactgattctatccttacaagaaacacaggaggtaggtgccatatcttgcataagtaaactgaggcacagggaactgaagtatgaactggtgaagcggggatctgaaccaagtccttgacttgagagtccttcccatctccgaggaagtgtcgccctcaataaatactagaaatagttgggttggcaactcagtgcttccattaactccatgtggctgaaacacggttggtacattgtcaaaaatggtagagaaatgttcaattacatgt

SEQ ID NO: 400819 - DNA, 256 bp, Homo sapiens
caaaggaccacataatttataattctatttatggagtgtctataaaagacaaattgaaaaatggttgcctggggtggaggtgggaataaggggtgattatgaacaggtgtaaggtttctttttaggtgttctaaatgttctaatattagtatatggtgatggttgtacaattctgtaaacatactaaaattcattgaattacatacttaaaacaggtcaatttcatattatggaaattgtatctcaataaagctgc

SEQ ID NO: 400820 - DNA, 497 bp, Homo sapiens
gttactggaagtaatgggagcagaaagggtttgtaccaaggctcctgaaatcacgcaggatgaagcagaaatctactctttgacaaacatggagggcaatattggaatcaaaggatgtgagttcaagtcttggctcttcaaattctatcaggctcgctctcaagttcttttgtgcggtgaagtcaagaatccgtacctgctcaccagcaacaaaaccacagtgaaggagcagaatgcctgtctgactcaccctgacagatcagctatggcaggtctgctgttgtagaaaattcttcaccccagaggctttatctctcctgcagggaaggctcatgagcaaatgctgtcattagcaaccatgcattgttgaagacatatagtgagaaaatatgtcaggtattgtttcaatgtaccaatgttagtagaaaatcctgaagaattttcgagatattaactgtagattaaaacaacctttaacctaaatcctgagaatttcc

SEQ ID NO: 400821 - DNA, 359 bp, Homo sapiens
gttatgccaggcactgtgccagatattttgcatgttattttacttaatcctaagaattatcctacaaagtatatcatcctcctttttacaaacaagggaattaaaagacactcttagcaaagttaaacagtgttttcaaacttcaggtcacaatccgtcagtgggtaatacatcaatttagtggactacaaccagaattttttttaactgaaaagggaagagtgtttcaggagtagtaaatatttttccaggaagcttttttttttcaggagtgtgtgtgtgtatgtgtgtgtgtgttggatcaggacgtgtaatgtatttgctactgtggattacagacaaaaacaaaaatttcaaaa

SEQ ID NO: 400822 - DNA, 403 bp, Homo sapiens
cacattctttagtcatcatctttttttactctccacttcttcattctaagttcaattttcttcttagaaaaatgcatcctttagtgtgtatgtgagtgtgtgtgtgaatgagagagctgtcttgagaataatttatttttagccaatcaggtctgaaaatgtctattttatcctcacttttgaatgacaattttgctaggtataaaatccgaggtcaaaacctatgtcctctcaattttttggagattctcttgctttctggactcttattattgataagatactttttgttagtctaaatatacttcctatattaatctgtcttttctgtctgtttctttaagactttcttattgtatgattttctatagtttaccacactaggtatggtcttgaatttatt

SEQ ID NO: 400823 - DNA, 293 bp, Homo sapiens
aaatgcacatacacacatacatgaatatttattctttaccttcgtgactgtcagggatacctctatttccacagttacctatttgttcccctagaaggaatgcctcaagacttctagtcttgtgtccttacaagctctctctttaggctgaagggtagctaaatctctcatctactaagtttgagacatgtcttattctgagaatctctcttgaagaacagttctgtgttccaactgctaggttctcatcgcctcttctctttcccactgtgatctgttttagcatggactta

SEQ ID NO: 400824 - DNA, 473 bp, Homo sapiens
aaatagcatgtgatgacaaagcacaatcccagatgttgaagtcatttcatctagagtttggatatttagactatgtgaacccggtggtggtcagtagtgtttaacttatattaggttctaatgcactaacctgtaaaggctgtgacataatgctcttagtgattaaatagtttgtatataaggctaggcgcgatggcttttgcctataaccccagcactttgggaggccaaggcaggccgaggtgggcagattgcttgagctcaggagttcaagaccagcctagccaacatggcaacaacccatctctacaaaaacctacaaaaattagctgggcatgatggcaggtgctgtagtctcagctactcaggaggctgaagcgagaggatggcttgagcctgggaggctgaggttgcagtgagctaagatagcaccactgcactgcagcctgtgtgaaagagtcagagcctgtctc

SEQ ID NO: 400825 - DNA, 349 bp, Homo sapiens
atcacaaaaaacaattctaaagaatatatatctcaaaaaagaaatttcaagaaaaatgaaaaactattctgaactaaatcaaaatgaaattgcaatgtattagtatttgtgagatatagttaaagtattgctctgagagaaacttatagtatttaatgcttattttcggaaaagaaaaaagatctacagtctgcaaacctaattttcacctacagaaactagagaaggaagagcaaattaacccaaaacaagcaagactaagtaaatagaaattacagtagaaatcagtaaaaccaaaaactgaaaaacatcaattactgaaaccaaaagctggttcactgaaaagatt

SEQ ID NO: 400826 - DNA, 409 bp, Homo sapiens
cccccatgttaatcgtagaaactaaggcctagagagattaaaaaacgtccatggggtcacaaggctaggaactgtggggtttggaaataaacccaggcaatctggctccagtctgtggctgctaactgctttccacctcagttaaggttgagtgaaagtacagacagagtggttcatgcctataatcctagcactttgggaggccaaggcgggtggatcaactgaagtcaggagtttgagaccagcctggccaacatggcaaaaccccatctctactaaaaatacaaaaattagctgggcatggtagtgggcacctgtaatcccagctacccgggaggcggaggttgcagtgaaccaaggtggcaccactgtactccagccttgggcacaatggcgaaattccatgtaa

SEQ ID NO: 400827 - DNA, 407 bp, Homo sapiens
gccacccagtgagagagggactggtattagccccgttttctcaaatgtacagtgaggcatcaaggtttcatgtccaggcccatggctagtgaccaggagagccaaggtgggcaccccatcagggtggcccagagctggtgagtgacttccagatggaagacagcctggggcaccaccatcctgccagtcacccctgggccaggcacaggtctccttggcctgtcttgaattatgacccattttttccacccagtggccatggctgacattggccttctccctgccatcactgccatggtgtgaattcaggtcccacccctctcatcagcctccttactggcctcctggcttctagtctctccactccccagcttgtcctccaatagaacctttctacagtgtgagtc

SEQ ID NO: 400828 - DNA, 349 bp, Homo sapiens
tcgcttgcaactgaaaggcggaggttgcagtgaaccaagatcgcaccactgcactccagcctgggcaacaaaagcgaaactccgtctcaaaaaaaaaaaaaaaaatctagtcggaagatgggcaattaactaattatatagttcaaaattaaaatatataaattattaaatgaaaattaaacttataacacaccaatgaaaataaatgacctacaaaatacacaatgaaatggataaacctcacaaaagtaatgtgcaacaaaaggagctagacacaagagtatacactgaatgtcttttacacaagatacaaaaaaaaattcatctgtgttgttagaggtcaggctag

SEQ ID NO: 400829 - DNA, 370 bp, Homo sapiens
cattatttataatactttttatatattataaattttatatattgtaggagagcggtcagggtgatgggagaaattacagggaaagacacaaacgttcttggaaggctgggaggttttgcaaagcttcgaaagaaaatttggctgaaggcagccaaattctcttattcggagcctgagagcaaagggtagataacaagggaatataaaggaactaacctagataaatttgtttactcctgtctccagaaacaaacctttgatcattcacacacaggactggtctctacttgggggggtgacaatgtttattacccacaaattgtgtttgccccaagcctttgtcattaaatctgtactaaataaatgtgag

SEQ ID NO: 400830 - DNA, 318 bp, Homo sapiens
actggacccattagtaggcattcaataaatgttagtctttaagagatcctgtgtagcagaaacatagacagatctatcagacttgaacatatcagcgtttaacttctggctctaccatttactaatgatgtgatttaagcaagttatctagctttctggatcttagtttcctcatttgtaaaataaagatggtattacctaccttgcaaagctttcttttttttttttttttttttttttttttttgagacagggtcttgctctgttattcaggatggaatgcagtggcgctatcaaagctcacttctgcctcaaact

SEQ ID NO: 400831 - DNA, 1068 bp, Homo sapiens
aaaacgcctcggtggcctccagtcaccctcaaaatagaatctgagctcccttcttggcctacagagcaccacgtgatctgaactccacttctgagctttccttgattctttcctctggcttccctcatggccctccaccgcggtggagcttccttctgctgtccctcacatttggcaggttcatttcctcctcagggcctttgcacgggcagtttctttctggaaggctatttgttcaggttttcacaggagggcttctccttgtcattcagatctcaggtccaatgtcacctctcagagagcgcctcaccccatgtgaaatgcacaagtacagatcacgcctcagacccactacattttcttcatgtcactcagagctatgatctgttacttgtttgttgcctgtctctcctaatagaacaaaagcccagtgagggcagaggtttgcctgtttcccaagaacctaaatcagtgtatggcacatagagaagccagcatttgttgatggattctgaatgaataagtgaccagcagcattggaacccatggtctcctttcctcaaagccagtgcccttaaccctggaataaatgaggtgcaaagcctgggaaggcacttctcagccccctgaggaggggcagacaataccacagaagtcctcagccacagacaccattccaaggagactctatttctaaggatcggttctttgatggttagttggttaaaaacatcacactgtgtcaaatgaaaagagactcatctagaatcctgctatggtctgaatgtgtccccccgaaagcatgtgttggaaacttaatcctcgaggcaacagttttgggaggtggggcctaatgggaggtgtttcggttacaaaggctctattctcattaatagatcaatgccagatctaaaaggacttgaggctgtgagttccatctcttgttctctctcaccctcttgccttccaccatggggtgatacaagaatgccctcgacagatgctagcactttgatactggatttcccaccctccaaagctgaaaaataaatttctttcctttataaa

SEQ ID NO: 400832 - DNA, 502 bp, Homo sapiens
cagttttattttaaatttattgagaaatctctatttcggttttcataatggctgttctcatttacactcagactagcagtgtgcaagcattccttttacttcacatctttaccaacacttttttttctttttaataagagtcattctaatatgagtgactttttatctcatagattttttggcttgcctttctctgataataagtgtaattgagcattttaaaatatctcttggccatatgtatgtctttttaaaatatttaagccttttgctcatttttcatagttatttgtttttttattgtatagtcactttcttacatgatcttgatattcaccccttgtcacaagtatggtttgcaaaaatgttctcccatttgtcttgttgattatatcagattctgtacagcaactttttaatatgaagtaatctgactcatctatttttcctttagttccctgggattttgaggttaaattaaaaaaaattactgttgaaacca

SEQ ID NO: 400833 - DNA, 418 bp, Homo sapiens
gattataccatctgctttctgccttccagaattcataaaatcgtctttctaatcatcacccctttcttttttcaactcctttgtggacattttattccattttctgcatctcttttgtttttgttttttttctttatttcttatttcagaggattggagtgggaaggataaggtatactgtgtttcagccttgcatttaaaccaaaagtctcaaccatgtttttttgttgttgttgttgtcttttttgagacggagtctcactctgtcgccaggctggagtgcagtggcacaatctcggctcactgcaacctctgcctcccaggagaatctcttgagcctgggaggtggaggttgccctgaaccaagatggtaccactgcactcccgtctgggagagagagtgaaaccttgtctcaga

SEQ ID NO: 400834 - DNA, 511 bp, Homo sapiens
gactctgcatagaggcagtcacttagagtaattaataatcttgatacagctgtagatcatatcttattttacatattacttttgacttccagtttaagttgtttgttatcaagtatttcaggagagaattgtgtacattaggctatgtttactgcagattatgtaacatgcttttatgagattatagtttgtagtgcttgcaaatataaaacatgtaccctgataaactataatcactactaggttgaccagcaaggacaaacatgaaaatgcttaaaaaaaagaaagcgcttaaaacaaagaaatagaaggtaatgggcatatataaaataagccaagcaagagaagagcaaagacaatctgcagggtggacatggatgtattcgtttctgatcatgagaagaggctcttgtcatacatatcgttccatttttattttaaagttctataaacttctgaggtaaactgatttcttggatgtacttaataaagaataaatgtttcatattgg

SEQ ID NO: 400835 - DNA, 394 bp, Homo sapiens
tgattacagcaacctcttatttgattacaattgttaaatatttatttttgtgcctaaagaagttagaaaaaacaggttttaagggctcaaaagtaactttcctttttagcaaaggatagaataacattacaaattcacagtgacagtgattgtgaaaactaccaccagaacactttataaatgtagccaaatcagaatgatctctctgtcttttatgccaaattcttttgtggtatccatgtttgactgaaatgaaataagtcactgggacttatacattcaaaaataaaacttaatgtttaatccctgagaatactgggaactaatgtgaaaccaccaattcttaggcttattacattcacaaacattagtctagtacaaattatttcttaag

SEQ ID NO: 400836 - DNA, 445 bp, Homo sapiens
ttgttctgctgacctcagaaggcatctttatgactactatattgaatcctctgttgggtatgtcatatatcatcacttaacttgtgttggttttaggagatctaaaccatctctccaagtcttgtcagattgacctcatgtagggaaggatcttaccaatatgtctgatgagagatttttaaggtgcctttcaaatctttgtgttttatcagactactatctatgttttcagtggccccctgaagcatagtgtgtgcctcatcctttcagcacttcgacactagtaaggtaggagtgagactctctagacatagttggaataggtgatgtgttggatgtgtgtcccagtttcttttagcctcataatgaagctaagtatagatatttatctcccactgtttcttcactaagctagggagatgatctgtggaaaatgcttattcat

SEQ ID NO: 400837 - DNA, 304 bp, Homo sapiens
agtcctgtgagtcccttgatccagctgtggagctctgcctccttctgggggtcatatttggacagaagctggttcttgacctcagcccacagcccatatgaggggcccttgttgaactgcgtggagctcatggctggcagacacggcggcgggatgggaccggacaggacgggacagtacccgtgaatttttcattcttatctgcccacttttattgggttgctttttcttactggtttataaaagccattatatattggagctttgaactttttattaaatgtaatataatcccaggctgtca

SEQ ID NO: 400838 - DNA, 555 bp, Homo sapiens
tttgttgtaaaaagttgagtatttttcaaacatcatttaataatagggtagcccctaaaacaagtaaggagctataagtctgagttgtgaatttgactagtaatggaataagaaaaccaagccaaactccatctaaatatgtatgtaaaggtaatgcttgtaaaaatttgctttttcctcattttgagatttcagttgccagttgactattggtatgcaaaattaacaattctgcctaaaggaggtaaacgatagaggttaattcttaaataaaagtccctttgtttcactattaactttttctatttgaagcataattgtgtcagctaatttattttttggtaaccacttaggaatttgggagggaggggggcactcaagtaagcaatgacagccagctagacatcaaaatccatgttctcacttcatggccgtacagataaatttcatttcctagcctctcttgcagttagatgtgggcatatgactaagctctagctagtggaatgagaatggatgtcaactactttaagctctttaagtcaactaaagaaa

SEQ ID NO: 400839 - DNA, 693 bp, Homo sapiens
gccctttccctcacatcctacagggacacacggcaccaatgtggcttcttactgaggatgctgacctcgatcaccaggctgaggtggtgtctgcaggtttctcctctataaagttactgcttctccctctccctgctctggaagcaagtcactaggtccagcccacatccagggaagtggacttaggctgcccatcctggcaggaggaggatcaaagaattagtgggcctgaggttagaaccatcaccatcattagtaaatttggagagagatactcagaggctatgcagatatcctgtgtcaccctgacgtattcatccatggataggtcattcttcttttagtgtgagtatcaaaagcaggttattcggtgcaaccagtgaacttgagagcagggactgggaagccctggagttgtcgtggctcagccccgtgcccctggctgtgttccttccctcctcactgccaagatgctgctgagccctggtctcacaaacacctttgagtggtctgctcactgctggggacatggactccgacaccttcctacccctcaccgttcccctctcctccgacttgccaccgccaaagccagcagtgacaaaggaggtgccaggggcagctgctccagcaggagctctctctgtactccggaccctgacatggatgaaaacaagatatgcttgggagata

SEQ ID NO: 400840 - DNA, 476 bp, Homo sapiens
gttcctttatgtacagaaccctgatgctaatataaaacactttcaagattattcacattatatgtgtctacagcttaaatgttatcgagtcactataattcaaacagatttaagatagcaaagggcattacctgtaagataagaagagccaggaaatataaattggctgctctcttaaactgctcaaacagattcattggtataaaggtaaatgcgttgtacttgtatgttttaattgcattattctgttggaaaaaataagagtcattctaaatgatgctgtatttatcacaatgtatacacatctgcaaaagtcacaagtcccacagcttacagtgacaaaggaacatcatctgtcagaaagatattgaggattttgtctgggtgcggtggcttatgcctgcaatcccagcgctttgggagaccgaggtgggtggatcacctgagcctaggagtttgagaccagcctggccaac

SEQ ID NO: 400841 - DNA, 259 bp, Homo sapiens
  misc_feature (64)..(64): n is a, c, g, or t
  misc_feature (154)..(154): n is a, c, g, or t
  misc_feature (196)..(196): n is a, c, g, or t
  misc_feature (255)..(255): n is a, c, g, or t
attaacatggggccagagcatggccatgggccgaaggatcaagagcgcttcccacagtgcccanaatcactgagcccgggacccagcccaggggacagggatggctgactcacaccaggtgctccttctgtgcaggcgtgcgttactgtctganccatagacgcgcaccatctgctccaggagatggatccccatnttgtcatacccatttacaagatgaggaaactgaggcttggaagacttgggacttgcacncagg

SEQ ID NO: 400842 - DNA, 1137 bp, Homo sapiens
tgctctgctgatactgtgccagaagtttgggttctgaagtccacaatctttacaacgttcttcccacatatgccagaatgagctattataaatcgggcagtcatgtcattgggagtgtattctccctctctatttgacaggaaacttgagttgttgggtgtctgactcctccatataacatgtactgcgttgaggggtgtgttcctcctagtgccatgctttctccagtttctcagtcctttatcgaagggtggttaagaatgaactcatttttagctagacccatttcacacatagccaatggtaataagagctatcatttcccaggtgcttaacatacagctcttaagtaggtagcattatacctttttacagaataagaaaccgaggccgagaagttacagtttgctcaaggtcatgcagctagtagaagtcacctccaagtcacacatcccatactgcctcattcataatgtctatgctgttgtcatcattgtctccaggttcaaaaggactctctgtgttcaaaagtgtccgttggtgaatggaagacttaaatcttagttacttctgaatagttgaggagggtgagaagatgttctcagtggtagtatatgatttttactgtttactcgcaaaatgaaacactgttttaacctaagtatatttttgaaaaatgacttttttcattgttggcattcaaataaaatcttaaaagtaccaacgtatactgctgcatttgccactctgtgtgaaggaggatgatttgccaaggagcttaagagtggctgcactttaaatcttccacttactccttaagtccaagggtatttgtccaaatgcattttaaactctcattctaaaattaaatatatttctaaataccagcactttgcgaggctgaggcaggtggatcacgaggtcaggagatcgagaccatcctggctagcacggtaaaaccccgtctctactaaaaatacaaaaaaattagcctggtgtggtggcaggcgcctgtagtcccagctactcaggaggctgaggcaggagaatggcctgaacctgggaggcggagcttgcagtgagccaagattgcaccactgcactccagcctgggcgacagagcaagactctgtctca

SEQ ID NO: 400843 - DNA, 566 bp, Homo sapiens
gcggccgcctactactactaaattcgcggccgcgtcgactttaaatcttccacttactccttaagtccaagggtatttgtccaaatgcattttaaactctcattctaaaattaaatatatttctaaatactagcacacattttgaaaatgacattttaagaaaaaataataccacttataataacaaaccaagagttgggtaaatggtacctgagactgttctctttactttgggggcgtatttgaaaatttccatgataaaatatcttttaaaaaattaagtggccaggcgcggtggctcatgcctgtaatcccagcactttgcgaggctgaggcaggtggatcacgaggtcaggagatcgagaccatcctggctagcacggtaaaaccccgtctctactaaaaatacaaaaaaattagcctggtgtggtggcaggcgcctgtagtcccagctactcaggaggctgaggcaggagaatggcctgaacctgggaggcggagcttgcagtgagccaagattgcaccactgcactccagcctgggcgacagagcaagactctgtctca

SEQ ID NO: 400844 - DNA, 331 bp, Homo sapiens
tactgaaatcaattaactctgacatgttatttttgttgttctataccgaagctatgtcaagtgttgggaatctgcccttctaagccacaagcttctggcttatagagttaagttgtctcaggaccacctggggagccttgatggtatctgaaacaaaaacagagaactaagaaacatatcctattgcacttaggcaatattcccattattttaataatgggaaagggaatctatttaagaaactcaggtttctatacaggagaagatgagggatatggaacaaatggagatgagagaatgaggtaaatggccttcaaagttaggtagagaa

SEQ ID NO: 400845 - DNA, 3053 bp, Homo sapiens
  misc_feature (150)..(150): n is a, c, g, or t
  misc_feature (854)..(854): n is a, c, g, or t
  misc_feature (1777)..(1777): n is a, c, g, or t
  misc_feature (2464)..(2464): n is a, c, g, or t
ggaaggcctttctctccatgctccttttgcgggaactccctggcaccaaggccaggggggaaaggacagtctctgatgaggatgggtctctaggctgctctgagtgctgtccctgcactgaagaagttatagttccctcccaggcggccncctccctgcccctcagctcagcctcaatcaagaagttccccatctttgaccactccaagtaggagaaaccggcccagggctcccttagagccgagaacagtggtgagttaagggccagcatggacagcaactctgggttacagttaagctggtgaggagctcacagacccatgcagaaagctcctactgtccctgactcctggctcccagctggagatccccactgatgctgcagcaggttccgcaggtcttacccttcagtgtcagcaagagcagggtcggggacatcaggggccggcatgggacagggccgggcctcccagcacctggtaaccctctcacttacggacagagctggccatgacggaggaggtatggatgggtacctggaggccccatcgcccccggggacccatcatggccctctacagcagccctggacccaagtacctgattccaccaacaacaggcttcatgaagcacacgcccaccaagctgcgtgcaccggcctacagcttccgtggggcccccatgctcctggcagagaactgctccccagggccccgttacaatgtaaaccccaagatactgaggactggcaaggaccttggccctgcctactccatcctggggcgctaccaaaccaagaccatgctgactcctggtccagccctgaagtcagcatttccatcctggacaccccntgacccgacttggtcaccacctgtgttggagcccagagccccacgcctagaatgttggggagtcctccttgagcccccaaactgggctgcatacccacctgcttgtcccagcagcccccttggctccttgtccaggtgactactttccagagaaatccaccaagtacgtgttcgactcagcacccagccactccatctctgcccggacaaaggcattccgagtggacagcaccccaggtccgcagcagccccaaccatcctcagccaaatggacctggggatcctgggtggggtgtgtgacatggggcagcccgacggctgatctccagagttgggggagagccccagggaaggagcagtgggccctgttccggcctgaggctccacgtccaccctgcaggccccgctgcgtacatgctgcccatggtaatggggcccaataccgtcggcaaggcctcccagccctccttttccatcaagggccgcagcaagctgggcggcttcagcgacgacctacacaaggcaagggccaccccaactgagaacagagaatcacccccaaccatctgaaccctcccccggaacccaggacccaccagttcggccctgccttgccaatgcccctcagccccctcagcccttcaccctctgggcacctgccacgtgctggggttacactgcagtggtgaggaggggcaggcaacaggccagaagggagacgccctggccccagcatggaccgtgctgaggacaagagatggggtttaggaagcactgtctggagagagagaggcaatcttagatagggtagcatggaaagaagaggaggaggaaaaaataaaccatgagctatttgggggaggagggtcctggtttcagaaacagccagtgcaaagcccctgggtggcacatgcctgagagcntgaggggcctgagatggggaagcagcatcatggcacccaacagccctcgtccatgttgattttgccagccccaggccctcaggtccaacagggcagcaacagcctctctcacacacgctcagcgatgttcccaggactggcacacactggggatgccattgccagcgtgaggctgaaatggaggaagtgacccccacatgaggtaccccacaagcagtggggtgtgatctccacagtgtgacagaagacagaaggggaccttgatgcacgggcaccaacttgtagctgaccctgttgactcagagcctgagtttgctccctgtcctctagggccacacgccctgggtaggccgagttggtctgagcctcctttacctctcagaccccaggtcccgcagcctaccgccaaactgatgtgcgggtgaccaagttcaaggctccgcagtacaccatggctgcccgtgtggagcccccaggggacaagaccctcaagccaggaccaggcgcccacagccctgagaaggtccaggaagagcacagctcagaggggtcagggtggggcagggtcctggcccagagggatgtgtaggaaagagcagggaggggggctgggacacagacgaggggaaacagggtcaggctatggaaggacacagccaagaaggggtggaggggtggggtggggangggaggcacctgcaccctgaggaccctgtacatttccagcactaggcccacaggtaacccttcagggacatggaagcagagaccctgcccttttccctagacactgtgacagctactactgctgagtgctctgtgttcaaacctgggagcatagcttctggccaccttggccccaggttcaggaaggacagcagcccagccccagccaggcagagacctgcaggtgggggcaggggtgctggttcctatcatagcccctcctctcccaggtgaccctgaccaagccctgcgccccagttgtcaccttcggcatcaaacactctgattacatgactcccctgctggttgatgtggaataacgccagccctgctgtgccccatcacacccggcatctacacaagatccgccgggccacagagctcgaggctgtcttcaccagctgggctgggccagcctggccctgcagggcagagcacgcttgtttgggcaattgtaatcagttactttttttctatgctattttaccattttttaatcttgttttctgctgtgcccaaattattaataaatcagattgcattaaaaaag

SEQ ID NO: 400846 - DNA, 2620 bp, Homo sapiens
  misc_feature (150)..(150): n is a, c, g, or t
  misc_feature (854)..(854): n is a, c, g, or t
  misc_feature (1777)..(1777): n is a, c, g, or t
ggaaggcctttctctccatgctccttttgcgggaactccctggcaccaaggccaggggggaaaggacagtctctgatgaggatgggtctctaggctgctctgagtgctgtccctgcactgaagaagttatagttccctcccaggcggccncctccctgcccctcagctcagcctcaatcaagaagttccccatctttgaccactccaagtaggagaaaccggcccagggctcccttagagccgagaacagtggtgagttaagggccagcatggacagcaactctgggttacagttaagctggtgaggagctcacagacccatgcagaaagctcctactgtccctgactcctggctcccagctggagatccccactgatgctgcagcaggttccgcaggtcttacccttcagtgtcagcaagagcagggtcggggacatcaggggccggcatgggacagggccgggcctcccagcacctggtaaccctctcacttacggacagagctggccatgacggaggaggtatggatgggtacctggaggccccatcgcccccggggacccatcatggccctctacagcagccctggacccaagtacctgattccaccaacaacaggcttcatgaagcacacgcccaccaagctgcgtgcaccggcctacagcttccgtggggcccccatgctcctggcagagaactgctccccagggccccgttacaatgtaaaccccaagatactgaggactggcaaggaccttggccctgcctactccatcctggggcgctaccaaaccaagaccatgctgactcctggtccagccctgaagtcagcatttccatcctggacaccccntgacccgacttggtcaccacctgtgttggagcccagagccccacgcctagaatgttggggagtcctccttgagcccccaaactgggctgcatacccacctgcttgtcccagcagcccccttggctccttgtccaggtgactactttccagagaaatccaccaagtacgtgttcgactcagcacccagccactccatctctgcccggacaaaggcattccgagtggacagcaccccaggtccgcagcagccccaaccatcctcagccaaatggacctggggatcctgggtggggtgtgtgacatggggcagcccgacggctgatctccagagttgggggagagccccagggaaggagcagtgggccctgttccggcctgaggctccacgtccaccctgcaggccccgctgcgtacatgctgcccatggtaatggggcccaataccgtcggcaaggcctcccagccctccttttccatcaagggccgcagcaagctgggcggcttcagcgacgacctacacaaggcaagggccaccccaactgagaacagagaatcacccccaaccatctgaaccctcccccggaacccaggacccaccagttcggccctgccttgccaatgcccctcagccccctcagcccttcaccctctgggcacctgccacgtgctggggttacactgcagtggtgaggaggggcaggcaacaggccagaagggagacgccctggccccagcatggaccgtgctgaggacaagagatggggtttaggaagcactgtctggagagagagaggcaatcttagatagggtagcatggaaagaagaggaggaggaaaaaataaaccatgagctatttgggggaggagggtcctggtttcagaaacagccagtgcaaagcccctgggtggcacatgcctgagagcntgaggggcctgagatggggaagcagcatcatggcacccaacagccctcgtccatgttgattttgccagccccaggccctcaggtccaacagggcagcaacagcctctctcacacacgctcagcgatgttcccaggactggcacacactggggatgccattgccagcgtgaggctgaaatggaggaagtgacccccacatgaggtaccccacaagcagtggggtgtgatctccacagtgtgacagaagacagaaggggaccttgatgcacgggcaccaacttgtagctgaccctgttgactcagagcctgagtttgctccctgtcctctagggccacacgccctgggtaggccgagttggtctgagcctcctttacctctcagaccccaggtcccgcagcctaccgccaaactgatgtgcgggtgaccaagttcaaggctccgcagtacaccatggctgcccgtgtggagcccccaggggacaagaccctcaagccaggaccaggcgcccacagccctgagaaggtgaccctgaccaagccctgcgccccagttgtcaccttcggcatcaaacactctgattacatgactcccctgctggttgatgtggaataacgccagccctgctgtgccccatcacacccggcatctacacaagatccgccgggccacagagctcgaggctgtcttcaccagctgggctgggccagcctggccctgcagggcagagcacgcttgtttgggcaattgtaatcagttactttttttctatgctattttaccattttttaatcttgttttctgctgtgcccaaattattaataaatcagattgcattaaaaaag

SEQ ID NO: 400847 - DNA, 405 bp, Homo sapiens
gttcacgaagagggtagagctcatctgttgtgatcatagtaactactgcaacctccctgagggagtttagttctacgtctctcctggattttgggttctttttcaaccactacgctctttttctcttccctgaacctgaattttgctctcctcttctatgcattggtagagagtgagaaagccagctcatagtgaaaagacaagcaggcataaggagacgcagtgcggacagcggagcctattgatgatggagcactagactcactctttgcacatccctgtcgctaacaggtgggaggggttttgctctccttacgtgatactgccatgaataagctcagacttggtcatttattatctcctgtatgaaaatgtgaacacttgggccataataatctccaaaaa

SEQ ID NO: 400848 - DNA, 418 bp, Homo sapiens
ctgcaagctccgcctcctgggttcacgccattctcctgcctcagcctcccgagtagctgggattacaggctcccgccatcacgcctggctaatttttgtgtatttttagtagagacggggtttcaccatgttagccaggatggtctcgatctcctcacctcgtgatctaccctcctcagcctcccaaagtgctgggattacaggcgtgagtgaccgcgcccggccctccataacccattttgatattgagtcaaagggagaaaatagtatcttctctccattattctcaattgttttgtatcttaaatcctagcagcccctaccctaattcctatctcagttttatacccctagaaattttcctttacatcccatatccaggttggagtgcagtggcgcagtcttggctcactgcagt

SEQ ID NO: 400849 - DNA, 386 bp, Homo sapiens
catgtaactaaatacataaaattgttaagaactcagaaattactgtcttagcgtatgataaatgaagtatagaaaaagtatgtgggaatatgaagaatttgaacgtttatttagaacagcataattaataaatatgtacaagtttttacgctactgatcatatgccttcctgtcaagcatcgtgaaacatttataaaaatcctaaaatcagaagaccatgataaaaatctctataaaattttaaaaacagacctgacatggtggctcacacctgtaatcccagcactttgggaggcagaggtaggaggatcgcttgagcccagaagtttgaaaccagcctggggcaacatagtgagaccctgtctctattttataaaagttaaaat

SEQ ID NO: 400850 - DNA, 617 bp, Homo sapiens
tgtagaggtggagtctccccagatttcccaggctgggttttaactcctggactcaggcgatcctcccgcctcagccttccaaaatactgggattataggcgtgagccactgggttcggccctaaatgtatttttgacttatgatatcttcaatttagaatggatttatctgaacataaccccatcataagttgaggagcatctatggtgtcttgtgaggtttattccatatatagaaataaaatatatgacaacactacaaaagtttgaagggggataaaaggaattaaactgttgtaagatttctctattgttgtagaagtactgatgtatttttaccgtatttactgccttattgattagtgagtataatgagtcaaatataaagaggtctcgagagtattgtgtaatctgatagctagtagccacatgtcactatggagcacctgatgtgactagctcaaattgagatgcaatgtaagaataaaacatccaccatatttggaagctgtagtatgaaagaatgtaaaatatctcataacaattttttatattaaatatgtcttgaaatgatagtatgttgggtacatttggttaaataaaaacattattcaaatt

SEQ ID NO: 400851 - DNA, 525 bp, Homo sapiens
aggcagccaggctgaagtgttagccacacagtgggtgcaactgtcaccaattgccggaaggcctctgcatggagccaagagagcaaggatttctccatccacagcagtatccccaaaacccatcaagtctcagcctggggagtttggggccaggcaggggaatggagagggaacacccaggagtggggactttttttttttttaaccctggagcccaggaatgtttcaacagtcatgctccaaaggcaaggagtgaatccagagaatcgcccaactcattcccagctctgctgacctcagttggtgaattaggtttcagtgctgcccccaaatgactctgctcctcctgggaagcccaggtgagccattcgctcagagccatcgggttcacctttgccctcggcccagcacagtagctcaaatccctacaattatggttttaaaaaagctgttggcctaggaccaggcacttttgtttttctcatttgcagtgcaaaataaatgccgatttcttgttgacaacct

SEQ ID NO: 400852 - DNA, 674 bp, Homo sapiens
gttacagggagtttcagcaattcatttttaccatgcccattattacataagtcaaggtgtcttagcctaattgcaagtcaggtctgaatccccttgtcccagccatatcacttgaccaaagaacattttgaagactgtttcactcacatggttgccactaacttctgtgctgccatggtccagattttctaaaatctctgtgttcaaacaaataataccaggaattctaagactgagaaggtaagataggattcctttggaaattatccattaagtaatataaattaaaagaactttaaaattgtatagtgaatacattgactataactgaaacaacatttggagttgcttgaatatattttaataatttttagatacttttttttttttttaaagttaggttctcactatgtttccagggctggtctcaaactcctggacacaagtgatcctcctgcctcagcctcccaaagtgttaggattacaggcttgagccaccacacccggcctaatttttagatattttttaatttaagttcataatatgaaagaatatcgtgcaatattggtgatggtttttggttctagagaagctttgaaaactggaaccttgtttttcctgtgttttacaacatatacagtatagtgccatacacagtggggttattcagtaa

SEQ ID NO: 400853 - DNA, 691 bp, Homo sapiens
cccaagtcacgatgaagccaacaaaccttgatactaaatcctgacaagaactttatgagaagataaatcacaagccaatatcttaaaatcttaggtaaaatatcctaaacaaaatgtaagtaaataaaactcagtgatatataaaaagaacagtacattataaccaagtcaggttcatttcaggagtgtaagaatggtttaatattcaaaattatattaattcaccacattaactaaaataaaaagatgaggatgataatattaatatgcttatgtcaaaaatgcatataaacaactaagaataagagaaaatttctttcaaatgataaagtttatctacaaaacaaacaaacaactaaaccctacagcaaatatgatctttaatagtaaatattaaaagctttcctctggagacctggaaaaagatagagatgcttgttatcaccacttttgttcaatatttattggaggtcctggtcagtgcaataaaataataaaattaaaagaatattggaaaggaactaataaatctgttatatgactaaatatagaaaagaattgtagcagtacaaaaagactccaaataaattataaaaattaatacatgaatctgctaaggtcattatctaaaaggtcaatatataaaaatcactttatttctgtatatcatcaattactgagtaaaattttt

SEQ ID NO: 400854 - DNA, 535 bp, Homo sapiens
ctatgctcctttgcttagtatagtgctgtctctgcacacagtggctgcttaataagtgttgaatgcctgtttagaatgtgatttgatgggccatccggaataggagataatcatgggaaacgtctacaaaatgtctttcagaggaaaatgctgttgagtaattgtccaggttttgaaacttttcaagttttcaggcgtccttgtaatagcttcttccatttcctctgctaaaggtatgacagaagagctgggcaagttttggtagtcttaaaagcagtttaatggagcaaccaatttgctgattcatatcatgattgaatagtcataactgaaagtgcttgaaagtattaaatcagatttttcatgatggctagtttaaaataaagcgaaaacaccggtactgtgaagttctggtagaaatgttactagttcaagttcttccccttactcccaataataagtaaaaaataaatatagataatgctatacattaatatgtatgatataagtaatataaataaataatttctcttga

SEQ ID NO: 400855 - DNA, 4033 bp, Homo sapiens
atccagggtgcactaggaggtcttcttactggaatcaccttgtcattttgggtggccattggggccttcatttaccctgcaccagcctctaagacatggcctttgcctctatcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaacggactcagaagagaaagcctggtacatgttccaggctatgatcctaaggacatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaagccaacctgctccaaatgcccttgactacttccttcttgaataaattagggctggatttcattaccattcaaaaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattttgtgaatattgaaatctgagccaaaactagttagctttattaatatcttagggaaagaagagagaaagaaagagggagggagagagagaaagaaagaaagaaagaaagaaagaaagaaagaaagaaagaaagaaagaaaaagaaaagaagaaagaaagaaagaaaaagacaggaagaggaagagagagacagaaagaataaaaaaacagcaattctgaggatgagaataaattaatggtaggtattacatatgcatgtacatatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgaatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctca

SEQ ID NO: 400856 - DNA, 4668 bp, Homo sapiens
atccagggtgcactaggaggtcttcttactggaatcaccttgtcattttgggtggccattggggccttcatttaccctgcaccagcctctaagacatggcctttgcctctatcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaacggactcagaagagaaagcctggtacatgttccaggctatgatcctaaggacaaaagctacaacaatatggcatttgagactacccatttctaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaagccaacctgctccaaatgcccttgactacttccttcttgaataaattagggctggatttcattaccattcaaaaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattttgtgaatattgaaatctgagccaaaactagttagctttattaatatcttagggaaagaagagagaaagaaagagggagggagagagagaaagaaagaaagaaagaaagaaagaaagaaagaaagaaagaaagaaagaaaaagaaaagaagaaagaaagaaagaaaaagacaggaagaggaagagagagacagaaagaataaaaaaacagcaattctgaggatgagaataaattaatggtaggtattacatatgcatgtacatatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgaatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctcaacccaagtttattactcattgcacagttcaaagcaactatgactctcaaaatagcaacagaaggtggggagggtcttttccctttgtttatatagtatttgctaaaaatgaactttactattttgtggctttatagggttacaccatttcattctaaagagaaacaaaaagtaaaccattggccatgtggctttcaaacagtatttcaaagagaatattactgaaatatttttgtgctgttacagtcttaatcaaacattattacaaagatcagatacggaaaaaatagaggagtctccccttaattgttccctttgaaataaattgttttaaattattacagaagttatagctgtatgtacatgcacatttgtatatttacaagtctcatgtacttaatctcaatattgcaaattagctaggtttactatagagttaactgcttttatctagcatttataatcttgtagtataacctattttcaaataactaaaatttaattgatgtcatcaatggtacacatgaaaatgatacaaatttataaactaataaaatgtaactcgtcattgatagtaaatta

SEQ ID NO: 400857 - DNA, 4313 bp, Homo sapiens
atccagggtgcactaggaggtcttcttactggaatcaccttgtcattttgggtggccattggggccttcatttaccctgcaccagcctctaagacatggcctttgcctctatcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaacggactcagaagagaaagcctggtacatgttccaggctatgatcctaaggacaaaagctacaacaatatggcatttgagactacccatttctaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaagccaacctgctccaaatgcccttgactacttccttcttgaataaattagggctggatttcattaccattcaaaaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagaaagaaaagaagaaagaaagaaagaaaaagacaggaagaggaagagagagacagaaagaataaaaaaacagcaattctgaggatgagaataaattaatggtaggtattacatatgcatgtacatatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgaatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctcaacccaagtttattactcattgcacagttcaaagcaactatgactctcaaaatagcaacagaaggtggggagggtcttttccctttgtttatatagtatttgctaaaaatgaactttactattttgtggctttatagggttacaccatttcattctaaagagaaacaaaaagtaaaccattggccatgtggctttcaaacagtatttcaaagagaatattactgaaatatttttgtgctgttacagtcttaatcaaacattattacaaagatcagatacggaaaaaatagaggagtctccccttaattgttccctttgaaataaattgttttaaattattacagaagttatagctgtatgtacatgcacatttgtatatttacaagtctcatgtacttaatctcaatattgcaaattagctaggtttactatagagttaactgcttttatctagcatttataatcttgtagtataacctattttcaaataactaaaatttaattgatgtcatcaatggtacacatgaaaatgatacaaatttataaactaataaaatgtaactcgtcattgatagtaaatta

SEQ ID NO: 400858 - DNA, 4087 bp, Homo sapiens
atccagggtgcactaggaggtcttcttactggaatcaccttgtcattttgggtggccattggggccttcatttaccctgcaccagcctctaagacatggcctttgcctctatcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaacggactcagaagagaaagcctggtacatgttccaggctatgatcctaaggacaaaagctacaacaatatggcatttgagactacccatttctaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaagccaacctgctccaaatgcccttgactacttccttcttgaataaattagggctggatttcattaccattcaaaaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattttgtgaatattgaaatctgagccaaaactagttagctttattaatatcttagggaaagaagagagaaagaaagagggagggagagagagaaagaaagaaagaaagaaagaaagaaagaaagaaagaaagaaagaaagaaaaagaaaagaagaaagaaagaaagaaaaagacaggaagaggaagagagagacagaaagaataaaaaaacagcaattctgaggatgagaataaattaatggtaggtattacatatgcatgtacatatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgaatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctca

SEQ ID NO: 400859 - DNA, 3887 bp, Homo sapiens
atccagggtgcactaggaggtcttcttactggaatcaccttgtcattttgggtggccattggggccttcatttaccctgcaccagcctctaagacatggcctttgcctctatcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaacggactcagaagagaaagcctggtacatgttccaggctatgatcctaaggacaaaagctacaacaatatggcatttgagactacccatttctaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaagccaacctgctccaaatgcccttgactacttccttcttgaataaattagggctggatttcattaccattcaaaaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattttgtgaatattgaaatctgagccaaaactagttagctttattaatatcttagggaaagaagagagaaagaaagagggagggagagagagaaagaaagaaagaaagaaagaaagaaagaaagaaagaaagaaagaaagaaaaagaaaagaagaaagaaagaaagaaaaagacaggaagaggaagagagagacagaaagaataaaaaaacagcaattctgaggatgagaataaattaatggtaggtattacatatgcatgtacatatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgaatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgccta

SEQ ID NO: 400860 - DNA, 532 bp, Homo sapiens
cgcagaaaaccaatgctgcatggaaaaatgtacctaacaagagcttcaagaaatagtgacagaattaaagagggaaatccacagtcacagttgaagatttcaggacctttccctcagcagttgatagaataattagacaaaaacaaacaacagcaacaaaaagtaacaaggacgtagacgttctgaacaatactattaaccaccatgacctaattgacattctagaacactgcacccgaccagtttcagaatacacattctttccttgtgcatatgctacatccgccaaggtagactgcatgctgggccataacgcacattttgataaatgtgaaaggattgagatcataccaggaaaaacaaaggaagaagtcacaccaaatatgttctctggccccagtagaattaaattggaaataggtagcaacagatataggaaaacaccaaatatttcaaaatttaacgaagcacttatcaataatccatggataaaagaagaaatcactagagaaaattaaaaatattttgaacc

SEQ ID NO: 400861 - DNA, 512 bp, Homo sapiens
taaaaaataatataatctcctagacagaacaagggttttaaaaaaagtatgcctccaatataaaacctgggttacttcttactgttgtctaaaaccttggcttttgtcttttttatctttactcagaggaaggccatcctccccatcttacttctaggtctgtccttatacttcttttgtagctcctgtaccacacaactgagatctcaggagaaagatgagaatttccactgctattcagatattactcactgggaggcatatgtgggagcactggagtcagatgcccatacctactagcttcatggccaccactaactagtcctatagccatgggcaagttacttaatgactctgtgaatcagtttccttgttggtgagatgggacaactactagtatctttctcataaggttgtgaggaatcctgagtagtggaattacaggtatttcttctttccattatatgtcgataatttcccaatttttaaataataaacatgtattattctta

SEQ ID NO: 400862 - DNA, 197 bp, Homo sapiens
gaaacaccatttgccagaaaagaatgcctttcaaaacctaagcccaccttcattggcctttggttatgctgttttctcttctgtaaatgtcttcctcaagtcatctgctctccagtcaacaccatcacttccccacctgctcaatctttcccaggctggtgaattcctatccatccttcaaagcccagttcaatatc

SEQ ID NO: 400863 - DNA, 457 bp, Homo sapiens
ctggctgcaaaccagacttatctaggagactttgaaaagtagattccgggccagatgcggtggctgacgcctgtaatcccagcactttgggaggccgaggcgggcggatcacgaggtcaggagatccagaccatcctagctaacatggtgaaaccccgtctctactaaaaatacaaaaaattagccggatgtggtggtgggcgcctgtagtctcagctacttgggaggctgaggcaggagagcgtgaacccgggaagcagagcttgcagtgagccgagatcgcaccactgcactccagcctgggcgacaaagcgagactccatctcaagaaaagaaaagtggattgcaggccaggtgcggtggccctcacttgtaatcccaacacttggagcggccaaagctggaggatcgcttgagcccaggagtttgaggctatagtgagctgtgatcataccac

SEQ ID NO: 400864 - DNA, 580 bp, Homo sapiens
cacaagccaggtaggttagggtggcacaggaggggaggcctaatataacctgccaggaggtagctaagcaggcttagtgagggtacattttgtggagcactttggtctttttggaagtttccaagatgtttcagtacagccagccttgatcgttcttaggcacatgagggaggggctcacacacaacaagactcagaagggacatcttcctgtggtgggttcatagctggatacaggtccccaactccctggcccacatcaggggaccaaaggcctaaaaaggagtctaaattaaggaggcaggagtttcccatgatttctgaggggttcttgtgcacttctgagccaataagctagaagtagctgaacctcactggattttacgggtggggaaactgaggtagggagaagtctcatggcttgcccagagccacacgctgaaggttgaccccaggtccttttgcctgcactccacttctcatacaaaaacacgcaggtggccgggcacagtgactcacgcctgtaatctcagcactttgggaggccaaggtgggcggatcacctgaggtcaggagttcga

SEQ ID NO: 400865 - DNA, 406 bp, Homo sapiens
aaattcatcaaactgtggacatttatgacctatgcattctctttatgtagattaaatgtaataaaacattccccccaaatgatacagatactacacttatacattaccatgtcagtattcactgagatgtgtatgactacatgtatttgactctacagaaaaataatatacagacatgtttattcacttggtactttttaaattgtctagaacagactgagagtgacacgcatatttgattgtgaggacagtttttgtcataatatctggttatcgtgtgatattaaactactgaagtaggggccagcaaactacagagcaaaccagatcctgcccatagcctgtttatgtctgtctttgaactaagaatcgtttttacctgaagtgttgttttgaaaaaaaaaaa

SEQ ID NO: 400866 - DNA, 524 bp, Homo sapiens
tcctaccttctattctattctattctattctattctattctgttctattctgttctgttctattctgttctattctgtttttagaataacacactaggtaaagaaactttaactgcaaggagtcagtgacttttagtgctccctgataaatgatgttattgacaaaagtaaaaaattatttcattgtttttttcctgtattactatctcctctcctgtgcttttgacagtgtgtttagtggatggataatatgtatttctctttcccactcccagattccaaattccctgcctttttggcccacctcaccacaaaagctccatagtttattaatgtaagtttgaatggatgcttctttggggaaacttcaggagttaatggaagagtttcagaaaggaatgagaatgcctcaggagttgttctgtgatggaaattggtctgttgttctgttaatgctgatggaaagaaacttacaacgcttaataaaaatctattcttttagtaaaaaaaattgtgaaataatt

SEQ ID NO: 400867 - DNA, 603 bp, Homo sapiens
aggaagggatgggattcaacctggaaaaagtaatgaagttttagtgaacttggtaaggtagactcaacaattaatgatggataatgctaggacccaacactggtaatgagtttgtattatgactcaatagcatcactttatcactttaacacagatggaggcctaaataaccatagggtaatggttcttcttagatgcagaaggacacatttatataatcttagggaccccatctctgaggtcactcataatttatattaattcattgttattgccattgccccaagaatagataaggataagacatcctgtagtacaggtagcagagatataaactattcttattcttgtgtcttgtctataggaagggagtgtatcctggtgtaagacagcatatagtagagaccattgtcaattagggcctgtgaactaagacagggtgactggctaagtccacaacccattagaaacccagaaataatcaaatcatggtgagtagtaataacacttatttataatactatacggtataaagacaagaaccaattatgttgagtagctgtaacaaatagctctatcattcgtaataactttttctgtaat

SEQ ID NO: 400868 - DNA, 514 bp, Homo sapiens
ggaaaaacttggagacagaaggaagaacaaacggactcctctcccactgaatgacctcatgtatatgtttgccacttgggactatgacctgatgcctctttaaacctctaggtcattgggaacatccacaaaacagctgaaagatgctgttttgttagaatgctcgttgtaatgcaggatgctggtgaacccagtgtgaacttttcaaaaacctattgatcccaccccacccactctctagagctctcatattgacaaaggatacctttcacagattagaaagtcagtagactccatttcttagaggaaagttgtggaaaatactctaaaaatactgtgagtagaagaaagaagcagtttagagcttcaaattcaatcgggctaagttgggcaagctactgccttataggcagtaactttctcatagaactttaaaaagttttattttgcaataattatagacttgtgggaagttgcaaaaatagtacagagagggcccatgtactcttcatcc

SEQ ID NO: 400869 - DNA, 484 bp, Homo sapiens
  misc_feature (16)..(16): n is a, c, g, or t
ccaccctaggagagcnaaccccaaaaaacccatggccaataatgagagccaaatcaggagagcattcagcaaagcaattcttgctgtagaaggaacagcacaaaaagctggaaggaaactgaggcatgcgtgaaagataacttgtcagtgtttgcagtctactgagatccccgctgcaagaaaaggcaggatttccacttgcttcttggcccgcctctgttgtccagaatccaggacaggtgacaagagaagcagatgtgatctgcacaagctggcgcagctgggttgggagttgctcttcctggacaggccgggaagggtgctggaggggagggaggaggagagaggttttaggggaggggtgctgagcagtcagggacctgtaaggtcacatttctttcaggtattctttctaggtgtactgaatgggaacattgtctgtcatccctagactgcattaaagacctaaactgcttccatttaa

SEQ ID NO: 400870 - DNA, 849 bp, Homo sapiens
atacatggtttcatttcagttttattgctcctaatgcaatttgttttcattaatgagaacccacatgtatgcatgaatcagggttttgcactgatacctcctgtgtggggtatttctttttccaggttaggtttcattctccatatttaagatctattgtgtgtatattgatatttgcctataaatattaaagatgcacctgtggttcagagaatatgttaaaattcaagaaaagctaccgatctacctaaagtagcatcaactcgttttttaaatttgtagatatttccatttgtacatggaaatttagagggaatcttaagtgacggtgaaaaataaaatggattttataatgaaccctttaacatgcttgaaaggagtggattcaggagaattaagttcatgaaagtcaggtttgaactttaaatgtttattaactttattgatttttaattaaggacaggatttttttattgcattgaaaaagcaatgagtccaaactagaggcacggaagattttttttatgaaatcagtgtttgaaagtaaggcttttttttctttgcagttctgcagagttcttctgccaaattgcatatgttctggcaagatgggaaaaggctctctgctaaggtacaaaatcagagtatctcagataagccacaacagttgtggtatgatagtttgaccatatctttgcctttgctttgacaattcccttttgatttctaccttcttcctgacatgaaacttaaacatcagttcaagggcgaaacagcatctgaaaatgtcctgcaaagactaaatggactgcattcttttttgattctgaataaagtcttagaaaagat

SEQ ID NO: 400871 - DNA, 160 bp, Homo sapiens
ctggtcccctgttcaaggctacatgtttattagtgaagactgggaactgtactatatttttcttggtatattttggtgtacaatttgtacaatttagttgttgaatatcatcttttttttcccctctgaaatgatagtttagctgggtatacgatttttg

SEQ ID NO: 400872 - DNA, 436 bp, Homo sapiens
tttccagctgaacaggcaaccaggagtggatttggagctgagagacaacaaattgataactggaacactgccaaatcatttcctcctatattcttctttttccattcataagtcaaaatggatttgttagtccattcccaaattcctaaatcccagggtttctctagacaccaccatcaaagaattccaaggtaataaaataaacttattgaggcttgctctaggataggtgtttacatacattatctccctgctgcagtggtaacatagtgagtgctatacttttggtaagctgtctataagtacttgctactactcttattatttatttatttttaaggagtctcactctgtcacccaggctggagtgcagtgagccgagatggcgccactgcactacagcatgggtgaaagagcaagacttcatctcagaaaa

SEQ ID NO: 400873 - DNA, 995 bp, Homo sapiens
agagacggggtttcaccgttttaggatggagtttttaatagggggtgttgcacattccttagaataactcacaggctccttagcttcctcttttggggttctgtacatatttgtttcaggggtacagaatgaatcacatggctacagcagagcactcttgcatgactcttgcttactcattaaagaaactcgtacatgaatcaaggctttccttatggtctcaggctgttcttcattccctgaaatggtcagaacacccatcaagtatcttggaagaatgcatatctttaaaggccataaagaaagaacgtttggttaaaaggaaaaactgctctgccacccacttgtctgagttctcctttcttcatctttaatcaatatgtacatctgttcacttgatgttttaatactagttgaggtaaattcagcttcatcatgtttttccacagaggggaaaaaagtaaccctgacttttcctctgggccttttcaaatatctacatgtagtggtggaatgagcggaggacaggaaagaccctgggaggcaggcctgtgtctcaccccactgggcctagtattccaaccaccgcacaagactaattcaagaataataggcctgggttccagccttaatcatttccattttcattatggtttacacattaattgtaaatgaccagattgattagggactctttaaagccaaacagattgggaggcagtgcagggtagtgctaactgtatatgtttgacatttccatagacctggactaaacatccagacctgtcatttactagctgtgtgaccttgggaaagtcactaggcttctctgagcctcatattttccttacctatacaatagggattgtaactacctgtatgaaaattagtgtgaataaaatgaaacaatgtatggaaaagatttcgcatagtgcctgtaaccatcgtttattgaataaaagactgtaatgcatactgctctgatatgtgtggca

SEQ ID NO: 400874 - DNA, 899 bp, Homo sapiens
gtttgactaaatgatcatttagaggaggctgagaagtttataaaccttagaaaaaatatgtaagatacaacaccataatttaaaaatgtgctataaactttaacattaaaaaccttaaaacccataaagttcaatgtagtaaaggccctcagtttaagtttttaatattctgttgcagagaagtttaacctatgcatcataaaaataactgattcataaaatcagtaatctattacttctttaataatatcagttgaaaggcctataatatttggcatgttaaacatgtaatttttctcaaactaaacctataagcaatagtagcagttcttattataatctctatacagaacaaactcatttattttcatttttaggaaagttcaatgtaaattatctcattcagtaaatacaactggccatttataaacacacaagccaatcttttcctactgaatgcagcattttaaaatatggtttcgtttaaacagtctacttatttttttgcttcttattattcacttagtccttatatttcttttgccttaattttttcatttaaaatttctcttcagttgagtaacaattattcttcagtctcttaaaatcctgctcattaaatttaatctgattcatgctgcaataacagtctgactaaagccaagtcaattacatatgcaatgactgatcattttcagctctgctatttttagtggaattatatagctcaccaggagaacaaaagtgaaaaggaaaaatacccacataaatatgacttcttagggtcatctgcttgtgactgtagaaactcatagaattacaactgcacagaattatacagtttaaaatagtttctaaaggactttctaatgaacagactatgcttattaaataataca

SEQ ID NO: 400875 - DNA, 724 bp, Homo sapiens
gggttttgaaagtaaatccttctctgtttctttacgtaataagattaacttgaagccaagcagggtcacctaggctagttgctccaccgccctgttcccaatgcttgccttggtgaataggacacagaggacatggctgtgatgcaacttacaccagcctcctatggggaaggagagcctgctcctggaggagctctcaaagtgcacgctgagatctgctgtgtcccacacaaaatctgaactgaactgcagggtgccaacgaatgattctgtttacatcgtttttctgggggaactcaaaagacgtgcatacattttgtcgacccattcagtatctctgtcaaggtaagaaacaggaaatactatttttccaaaagatagaatcatagaatttaaaatctggaagaactctcagggatagacgctgtcacataaccctctgccactgcccaagattccaaagctggggcagagctgggacaactcataagcagcagacacggctacctgtcctcttacctgcctctgtgtcagctgcactcatggaaggaggaggtctcaaaggctatcccagagacaggcttcatgcccaggattccaacactattcattttcaacaatcctcattatttttgatccgggagacgccctcaatcaggaacttacatgtccacactgcacgccatctgattctctccaagtaggggcaagaggaccggcgcct

SEQ ID NO: 400876 - DNA, 429 bp, Homo sapiens
ggccaaggtgctgtgcttgtggttttgctttacacttggtcctagccctataacatagtaaggaatagggataagatttctgcaattagttatcatgcaaagtaattggtctaggccttttttaaaaggtttagctcctggccatgagaagaatggtacttcctcctatggcatttaaagtctgtctactcagatacctttttctttccaggccttcttttccatgtgctaaaataatatctactgccttatagtaagcccactccaaagttcagcgaaagagagggagcatctcttctttatgtctccagtttaggagtgagaaaactttctcagaaaacttcccacttccttctgtgtctcattaaccaagactgaatcatatgttcacttttgaagccaatggccagtcaagggaataggattctc

SEQ ID NO: 400877 - DNA, 646 bp, Homo sapiens
ttcagagatggcaaaggaaccatggcagtcagctcatgttcatgtttcatgtttattccgtttttaattttttgtacattttacacatcgtgattgcatatctacctgctaattctaatacatgatgtacaatcggtacagtaaaccagttgattgttatttggtcatctggggctctgggtgaccaaagctcctcaggtcatgggtaatatttgagtattgatgcaagcatgcaggaatccttagggcctctactggggatgttttcccatggagagtattgctttgtgttctctaggagtcagaaacattggctgtcttctgggattccacgctagggactgactctcaggcttggctgctctgcctcccattgcccagggcctaggctttgtctttagagcagtgttgttatcatcatattcctttagagctacccagtcattttcattagtttaattcctaaatcatttctctggtgtcatttctctgtcatttatttttgagggcaaaggtggagggaagctcggatatttcatttactaactactgagcctagcaaaacttattacttctttttccagtcatggcttgaagttttcagcttctgggcttaaggagtcctctacttaccttccgtggtggg

SEQ ID NO: 400878 - DNA, 993 bp, Homo sapiens
  misc_feature (889)..(889): n is a, c, g, or t
gggaagtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccacacgttagccaagaaccctggaacagcagcatcacactcacatcccaggccgggctgtttccagagctttgccaagttcagcaaatttggagatgacctgtactccgggtggttggcagcagccttggtacaacctgcaggtccagttctggccaaaactgtggatcctgcctctaatgncggatatcggcgagtctgaatgtgaccgatagttcctggaccgccgccaagttacagccgaggcccctcaaggggggtcccaagcccggctcgggggcacaacg

SEQ ID NO: 400879 - DNA, 430 bp, Homo sapiens
aaagcagattgtccaccctgactctgaaaaaagagcagcagctgcttctgccatctcagagggtcagctgagtagtgatgagagtggggatttgacctttagcttaaagaatttatcaaagaccccagccttgcaattggtacatgagctgttcatgaaaagcaagaggaaaagattacaggaaaatagtggacatgaattcttagagcaaggggatggggagaaaatagctgtactgcagtgtatacttgcaggactgattggcaagaaaatgggtatagaaaaactggacatcttaacagaattaaaatatagaaatttaaagcatattcttgctatggttttagagtccttgaccgcagagagcctatgcaggtaagaagtaagagttgtttatgaaataaaacttctttttttaagttgaaaagtt

SEQ ID NO: 400880 - DNA, 501 bp, Homo sapiens
acacagagacacagaagatgatgaagggaggaaaggcccattgcaactggaagcaaagggagaagggaggttctagaaaagtgacagctctcagggagcaagactccctgccgagggaggcctggctgcaaggcggagctgctgcaggctgcccatgttaggccttggaggtgtcacctaatttactgtggtccttccaggagccctgggggcctcgcccagctgacttaggagctaccacaaagttagctacctgtaagacagatggtgcttgaatagaacagcaaatacattgaataaaataaattaaaaagcctcctcctgaaccaagattttttggaaagaattctaaatagatgaaaacaaacaatttgatttcaaccaaattgttgtttttttgtttttatcctgattttcacccgaattgtcagtctcaaaaataaacactgatacattcccagaaaatatttttcaaataaaaactgactctgttaaagtttg

SEQ ID NO: 400881 - DNA, 434 bp, Homo sapiens
gccccactggggtgtgggcgagggccaggcgctgggcaggaggaggagcagatgcctcgtcagccaagtcgaggctgaacaggcaggaggggccgttactgtgtgagattactggaggagcacatggggttgcagatgaacctcctccaccatgtttgtgtgcttcatgctccagcaaggggcaggggcagggacaggggcagagacaaggttggtgaatgcccttcattgtggaaggggatgatgcagacatgggcattctctatgtttattttaaaatttcaataaaaagtaaaaaaaaaggcaggggattacctgtattttgctaaggggggtaataactacatgaagtggatttttatctctatgtagtcataaatccatgtttactatgagctacagggtcttcaataaaaaaaaatttgtctatgaca

SEQ ID NO: 400882 - DNA, 379 bp, Homo sapiens
tagtgtttccccttaagggcagacaggtctttcctggtatattcatgagaagaggcaattcctaaagcagaaaaactgagtgacctctaggtagataagagaaaaaagctctgcctcccttcttgctaaactgtaaagaatgtaggtgtccaggaaagtgagccctacagcctgggttttaacaatatcctttttcaggtggatgcagggagatagccagcaaggacaggccagcattcaaagtgccatataggatgaaagtctctaaactacttcgtttgctagattttctaaatttgttttactcttttgttaggtttctttgtaattgtctagccttgcagtaaaatcttgtttgactattccagatttgtcagcc

SEQ ID NO: 400883 - DNA, 447 bp, Homo sapiens
aggctgaggtgggaggattgcccgagcctgggaggtcaaggctgcagcgagccatgattgcggcactgcactgcagcccgggtgacagagcaagacctcaaaacctattttctcatttaggccattcatatcccttagtctgcttgaaataacccagcagccaatatatcttcattatcggaatcacccacaggaagtcagccttcatgacgttgtacttctggtagtctagtcagccactgtctgcagtccctgatcatcttctaaggtttgtttgtaaacatgtggtctgcaaccaagaatttaggatgtccaaatatggcaagtttttgccctctctgctatctagtaacatgagtaataatctttgctctccaacactttttatttgtcccaaccattgtcctaatattgtaactgtaatgcagcaaattagttgcctgagtt

SEQ ID NO: 400884 - DNA, 477 bp, Homo sapiens
ctgcaagaggaagctggagagttcccctttctcagccagaaaatgtgcttagagagaaagctggccaaggacttctgattgtggcccagacccttgacagaaatgatctgtgccattgtttaccctcctgagagacaccaagaccctgccatggctgaaccctggaaacagcttctgctccaactctctactgtggctgtgggcccggatatcccaggagacagacttcccctacatcaatcctggcaggcagcagcacagctgcggcaccatctccagaagctgttaacgacctttgccctctgactcgctgcaggaagaaagcaataaacagtggtctggggaagttgtcaggaagtgaccccaaaaggcacaggggccactgactggaaatgagcaaggcagaagtgaatttcctggcctgtacaacccctgctcagaggtttcactgcaaatacagtctccattttcagcaga

SEQ ID NO: 400885 - DNA, 529 bp, Homo sapiens
ctcttctgctgccattttcatcaaagactgatgtcacttggcatgtttttaggtttttttctggtggcttttatttttttaattttagagatgaggtctcactatgttgcccagcctagtctcaaattcctaagctcaagggatccacctgcctctatctcccaaagtgctggggttacaggcatgcaccaccacgcctggaccacattgcatgcattttatttaaatttttttttttttttttttttaagacggagtctcattctgtcacccaggctgaagtgcagtgagagactgtctcacaaaaaaaaaaaaaagaagtgtcaggtgctggcagagacactgcttttccctaattgacctgtttggtcctcacattaaccatattttacagctactctcatttacagataaggaaactgggccaatgaggaggtgagaaatcgctcaaggctgccaggtacagtggctcatccctgtaatcccagctgctttttctttttaaaaagtaaaatataacagagaaaac

SEQ ID NO: 400886 - DNA, 399 bp, Homo sapiens
ctcttctgctgccattttcatcaaagactgatgtcacttggcatgtttttaggtttttttctggtggcttttatttttttaattttagagatgaggtctcactatgttgcccagcctagtctcaaattcctaagctcaagggatccacctgcctctatctcccaaagtgctggggttacaggcatgcaccaccacgcctggaccacattgcatgcattttatttaaatttttttttttttttttttttaagacggagtctcattctgtcacccaggctgaagtgcagtggtgcgatcttggctcactgcaatcccgggttcaagcaattctcctgcctcagcctcccgagtagctgggattacaggcgtgagccactgtgcccggcctttatttaagat

SEQ ID NO: 400887 - DNA, 642 bp, Homo sapiens
tcagttgtacttttatttgcttacactattctgaggtgggtctctgtctcttggatccaaaagagttcaaattaataatcatttgacaaaaaattacctccacattcctaatgaagttgtctttgaagataatgtcttgtgatcccctggttgaagttaattactgcttgtgagcccccattaacaacgtgttcctttccccattgcttgcttgtatcagctttgctgaagatctattggctgtaggtgtgcagctttatttctgtgttctctattgtgttccattggtctacgtgtctgttattgtaccagtgccgtgctgttttggttactgtggtcttatagtttgaagccacatctgtgtgatgctgctggctttgttctttctgctttgggttgctttggctattcaggctctttctttggttccatctgaattttagaatagttgttttctaattctgtgaaaatgttccaacctctgtgaaaaatgaggttggtagtttgataggacagcattgattctgtaaattgctttgggcagtatggccatttttaaactatattgattcttccaatccatgaacatggaatgtttttccattttttggtttcatccctgatttctttctgccatgtttt

SEQ ID NO: 400888 - DNA, 688 bp, Homo sapiens
ctatcaatgattgatttctgagtctgatcatttcctcatatctgaactgcttcttgctttctgttagcactacccattattgaattataaaagcatttgagaattatgcagcacacgtaggtgtattatgtgaaaccattaggtcgttatttaggggattttgtacctttcgagagcttgtagtgcagtaaagacgatcttcatagacatatgtgagtaaagtacatagaaatgactaaattcagcaatctgaatatgtatctaaaatgtggtattaacatagaatattcatcaaaattaagtgccagacctccagtaaatgtgtacatcagtaacatgaaaatgatattaatcataggccatctaaggtaagagatcatttagtttattcattttgtaaatatgaatttagtccttgctatgagaggtgcatttgcctataacatgagctgccaagacaagtgagacaaggacctggcctagttccagctgctgggttataatcatatgtgctcttgcctttctgttctgccttcagctctgttcccttctcacactgtatttcttttgccactttttaccttgactctccctttcatttctcaatcatttcctttcatggagtgaacagtattcaccttgggctcggtgcgtgcaaaagtgaatgagactaagtagtaaagctctc

SEQ ID NO: 400889 - DNA, 1091 bp, Homo sapiens
ggaggtctggtttcaagcttgtgatacagtgaatacagacggcctagcacagagcgagggaaccagttagtgattctactcaggcatcagtggccttgcaaagctccccctgctttcatggtttttttttttttctctctcccttcttaaagagagggaaaaaaagctttcccctcgcaatttcattttttatttaagcaagcaaaatcttttagtgattttgaactgtagcaatcaggaaacaatgtttattctagtctttctttctcttcccaggagtttgaaaaataatttcagttacttgcaattgtcttttattttctcctagtttgtttggggtttggttatgcaagaagaactggtttaaaggcaataacctttataaacaacaaaaataaaaaagtaaatcacagatgctcaagcaataatgcattttaaaagtaaataataaccatttatgagatccctcttcacagcagacatcaaaggactttgttttaatagattgaaatcttctctctcctgctgtactgaattagaacccctaagttttattaccaacatcatcatcattattattgccttgcaaaatggactgccattttaatttcagaaaattggttttcccaatatactgagaatagtggcagaaggtttttaaattcctgacatgtgcctaaacatttttcctctcacagggaggaaaaagaccctcagggatttacaaacatgatttggaacctcagaaaaataaaatcaaggatgaatcaaatgagattaagttccagatctctaatataaagcaacatcaatagttctttcaaagcgattcttgaaatcagtgctcataaatatgtaatgcactttttatctaaaagacctgtttaaatcctcatatagtaaattatttatttcaagattaggtactcagcacaatgcagacaccctctgatcaagtgggaataaaatctgtgaaagcaaatggtaaggcattatgcaaatgtaaactgctgtgattatgattatcctgtgaatgggtaggtttgaaggaagaaagccaaaaaaaaagaatcaattatgtattcttcaga

SEQ ID NO: 400890 - DNA, 529 bp, Homo sapiens
ttcattttgagatgaatactgagaagtctttcattactctgcagtataaagtgtttactaaacagaattaagccacagcataataccctgccttccttcttctctatttgattcgtcctacttaacaccagcaaaagtacttctgccatttttttttttagggttagacaatttatgccatttaaagtgtaaaaatggaatttacttggcagttagagggaaaagaattgacattatctagacacaaggagttcatgggtataaagtctcagatcatcatttctgctaaagatcaagtacctaagtaaatgtaaaagactacactgagagagacatccccagttggaaaatgtgccaagtcatagaaaattgtggtagccctgaattttcaagaatggttttggccggatgtggtggcgtgcgcctgtggtctcagctactcgagaggctgaggcaggaggatcatttgaacccaggagtttgagttcagcctgggcaacatagcaagaccctgtgtcttactttttta

SEQ ID NO: 400891 - DNA, 433 bp, Homo sapiens
caaataaaggatttgttaagacaaacatgtttaatttggaaaaaggagccaacttacaaaaaaaatgttgttacactgattacttgaaattaaaccatatgttgttatgtatattttaatatctatatgttactgagagcttataatgatttttattttagggatcaaagctatactttttagaaaatattacatagtaaatataaagtatcttattattaactagagtttccatgctgtatattagatctccacaacttaccctgtatcgctgaacctttataccctttgatcaagatctccccatttcccttttccctggcccctggcaaccacttttctactctacttttacgagttcagcgttttcagatttcacatatacatgagattataaataattatttttagttgtcaagtatccttcaataaa

SEQ ID NO: 400892 - DNA, 239 bp, Homo sapiens
cttaataaaagttcttacatatttctttttttgtttcagtttagaaagaatttgaaatcagagggaaatattttttttcttaatcatgcatcctaactactcaccccaaatgaaatttgagactaggcctggtggctcacacctgtatacctagaactctgggaggctgaggcaggaggattccttgaggccaggagttcgaaaccagcctggtcaatatagcaagaccctgtctcttt

SEQ ID NO: 400893 - DNA, 445 bp, Homo sapiens
tgtttcaagtttaaaaatgaatggaaaatgaatatcaagactgaagacaaatttggatactccagtaataaatataaatcatgctatgaaagttcgtaggtgattcatagtgcctagttagagaatagcaatgaattctgtcgatgatcatgtgtggaaaattgggggtttcttttacgttgtcttttagaatgagttagttttgcaaattttcatcaaaggatttgttaaagttcagatgtttcctgtttttgacaatgaaagttattctttttttcctttttttctgtgttgggtggtgtttctaacatttgttggaaggaaaaaagccacttaggttctatggagataggttgatttcctgctagagttcatttttatgcccatgtttacctaaaattgagatctgggagcattttgagagaaattctagaccttttagtaa

SEQ ID NO: 400894 - DNA, 403 bp, Homo sapiens
aaacacagatttggggtgtcaaacaacttcatacagcctaataagtaactgtaattataaaaaaaggggaggcaattattgaagaaataattgccaaaatatttcgaaatttagtgaaatctaaaacacacagattcaagaaactcgacaaactctaatcataagaaatgtgaagaaaaaattgtaaggcacacaatcatcatactgcttaaaaccagtgacagaaatttgtaaaagcaaacagactgacacataaaggttattatttgaaagtaatattgtcggcctgatgtggtggctcatgcctgtaatctcagcactttgggaggccgaggaaggcagatcacttgaggtcaggagttcgacatcagcatggccaatatgacaaaaccccatctccact

SEQ ID NO: 400895 - DNA, 396 bp, Homo sapiens
ggatactgcccagtgattggattcagttttctgtaccgttttgcctccctcctgccactcttcacacatttccaacatttgaaccatcctgagctatgcagttccctgaaaaacatcatgctcttctgtggctccttttcttggctcctgctgttcccttatttgtttacaattagggaaattcttgcacttcatttaagacttagctcaaacgctgtttcgtctttgaaccctccactaggccatgttaactgccttgattttaaaccatcgtggaaataaatatactttctagaaaagaatttacatttcttagctggaaaaacataacccaacttggaattcctgagtatgcatctcttgtccccaccccttgatctgggggttctctagact

SEQ ID NO: 400896 - DNA, 448 bp, Homo sapiens
acatccaccaaagtccctgcggcggggggcggggtccgcccgagctctagctcggtatagggggctgccgcagcctgatcacgtctccgcctccctgactgggctggctcgtcgcctgctgctccctggcagctgtctgccgctgccgggaaggtgattgccatgtttgcagctcctttccttgtttggaaagatctggaggcaggtgaggctgccgggaaagcgcgactgacaggttgtgatctgcaggtttcggcgccgggctccgagctccaagcagtctggggaaggctgtccgtctgctgcgggctgcgttctgcctctgcgccccgtacgtgccccctctcgcggaccgggtgccggccttttcctctgggccccgcaggccccccacagccaccagaccccagccagggtcgcctggccctccctctggacccgagagacc

SEQ ID NO: 400897 - DNA, 387 bp, Homo sapiens
ctgggggagcctcgagacttgcaacgacccagacccaattccctgaggccccagcctgtggtggcagggcccacagcctgcgatctctgcataccctggatttcagaggtcactgcagtcaggccacctgaggacacacacctgagggtggtgcccaagccaagactctctctagggatgtccacgtgaccccagagaagcagcccaccccacagtccacccacagccttcgcgcctctccaggagctgggccacttttcacacacaggatccacgtcttggttattatcgaacactcttggagcttcccaagactgcagttttaaaagaaatggcggagttggcagtatttggaggtagtaatgaattttcatctttgttctccta

SEQ ID NO: 400898 - DNA, 253 bp, Homo sapiens
gcccggcaccgattgaggatctctttaagaaaaaatacaaaattgggtacaggaccttggacgggggcctgaagcttcagttactttaatattgcagttattgtccctggagccgtggttcgcactgtaatcccagcactttggtaggccgaagtgggagacccgctggagcccaggagtttgagcctgccgtgagttatgatctttggcactgcaccaccgggcgatagagcgagacactctacattaaaaa

SEQ ID NO: 400899 - DNA, 459 bp, Homo sapiens
attttaactgttagtatttctgtggtagtacctgatgatgaaattattagctacttcttcctcttcaccatagatactgataagtttctgtcttttgtcagtctgtaatgccagcatagtcaggtgtctttgatgcttttcatccaggtaaattttgtgaagcatgtctagcaaaatctggtagcaaattatttcccttgctagaagagtaaacagaaattaacatgactcaattgaactcctttccaaataaattctgtaacaatttagagctgaccatgagacttaaataaataaataaataaataataaataattatcgttttaaaagtaacaacttagtttagggctaagagaagataatgttgcttctcttgggcttctgttaattttcaagttctaatactagagctccagtacttcttcaaatactaccttcacacaatcaattttacatga

SEQ ID NO: 400900 - DNA, 436 bp, Homo sapiens
atgggtgctcatgagattaagtggggacaagatgggagagaatctttaagtgcaggcctaggggaggagagcagttgctgctgtgggaaaggcgtgaagcctggattcttctctcctgtagaacaaagcctaaagaccttgagacagaaaacctttcctggggaagggaagagataaaaccaccccttttgcgggaggggcaggttcttctaccactggaggaaaagacccctgagaaagtcttgtccttgatatccagggacagaggctgatctacaacaacaaagaatgcctccacaagcccaccattagactagcaagcaccaagaaacaggtctcaaatgtgtggggatgggtcaataatatggagagagaccttctctgaggcatagcctctgagcaaaagcctaaagctgagagtggaacaagagcattg

SEQ ID NO: 400901 - DNA, 538 bp, Homo sapiens
agtattcaaaatagaaaaattcactttatttctatgtacttagaatagacatgtgaacaggaaattcaaaatacaatgccatttacaatctctctcaaaaattaaattgcttaggtataaatctaacaaaacatgtacagaccttgtatgctgaaaaccacacaatactgatgaaggaaaacaaaatttaactgaaatgaagtgaagtgatcctgtgatcatgatcgggaaggcttaacatggtaaagatgtcaaatctccccaaattgatgtataggtataacatagttcctgtcaaaatcccagtaagatatttgaatagatacagacaagattattccaaagtttatacgggaagacaaaggaactaagtggctaaaacaattttgaaaaagaaagtggaataaaccagcctatttgatttcaagacttactacagtaatcaagattttggtgttggtggaggtatagacacatagtctaatggaaaagaatagaaaacccagatatagacccacacgaatgtgcccaactgatt

SEQ ID NO: 400902 - DNA, 526 bp, Homo sapiens
ttaaaaggtagtaaaattttctgggacagagattgaggatgttcttcagcaatcttacaaatgatttattggtttatttacataaaatcaaatcagtgtatattctatcttacattagctgaactacagtagcttccacaataagtcaagcacaaattttaatccatttaacaatctttagcaaacatttatttaaggactctaatgtttcagggatagtaatggttactaggtatacaaagcaaatcaatctcagttcgtgcctaaaaagtacataatctttaataagtttcaagatcatagagccatataatctaataaaataaataaattcatctgttttattgagcaattatttggtaccgactatgtgcaagctattgtgtatattttggtatgtgctaaaagtctatgattctgtatatgtttttcatgtacctatttttaataaatttgtattttttcttaatactatgacacaatttgcatttttaatctttaaagcctttcactattattcagtttt

SEQ ID NO: 400903 - DNA, 323 bp, Homo sapiens
ctattaaggatgttatctgcaaacctgcatatactgcacatatacccctgaacttaaaagctgaagaaaaataaaaataaatagccatcaccatacccaccctcaccccccaaagaaaggatgtcacattgctcaaatgaagagaataagcctgtttcaggcttccatctacatagctcatacataatttgtggtactcaaatttgtattatttggcatcctgacattaatggagttggaagccattatcctcagcaaaccaacgcaggaacagaaaaccaaagacagcatgttttcacttataagtgggagctgaatgatga

SEQ ID NO: 400904 - DNA, 548 bp, Homo sapiens
tcaaaacatcagctctcatgagaacttcctcactatcaagagaacagcatgggggaaactgttgccatgattcaatcacctcccaccaggtccctccctcaatacctggggattacaaatggagatgagatttgggtggggacacaaagtgaaaccatatcatatgctgacttgtaatgaatacctttcctaatactaatctatcctggcatttctgaaatggaaactttgtggtcctgctactagtcttttaatgagctgtttgaatctaattgctgttgttatatttacaactgtaatatgtatatttgcaagtgagattaacatgtaggtttttttgtacaatttttgttacatgttggtgtcaacgttatccaccttatataaaaaattttgcaactttttatatgtcctggaaaagttcaaatagcattgtaataacctatcctatggaagcttagtaataattcttatgtgaaactatctgggctgatatatatgttctatgagttgatggaggcttattctttaaatactttatttctcta

SEQ ID NO: 400905 - DNA, 358 bp, Homo sapiens
gatcccttgtggcccctatgcctgcctgccaggactcagctccctcggcctacccagtcctgcacacttaggccagtttgtctatgacaaggagagagaagaatggctgttttgtccacttgattgccttgctttctagaccatcttgggcccaaaggtctaggctttgcaaactcttcactgcctcgctccttggaggtgcttggaaactttttctccccctgttttctctgtaattgaaatttgccctttcgttacctgggcatgaattattttttgcagtgttgtcattccctatcctgctgtgaggtttatctcttctgttgatcctaattaaataaaacatactgttcaccta

SEQ ID NO: 400906 - DNA, 718 bp, Homo sapiens
ctgtgaagtgacaagcccagggcctggcagacagtaagtgctcaggaagcattgtctgaacagagatggagcagtctagtatgtaaggtgggaaagaaatagggtctttcatgatctaaatctaccaaagcttaatgccagagaaaagagagttaggaataggattttttggtgaatatcaaaatccaagtttaagccactagccatctgtatatagtcatcttggaagcggttatgaaacacccatatttgcacgaggttttatttgtccccacattgtttccctgttcctttgtaaaaccacaagcagtttttgtgtttatcactattggccttgaggaaatagaatattttgctttattttttcgatgtgtattatacattaaagaaaatacaataacatctcatgcagtttcaaaagtaaagggaacagtctttcccatgatttcatcaccctaaacaaacaatacttagacatcttttgtgctcctcctatctttgtctgtaaaaagagtgtactgtggtcttgctttcatcccttctttttctttcttttcgtcgtagcacaagaagtttttcatgttgtcacagtttaaataagtctcatttcttatggcctcataaaggttcatctggcattttcttgcaagtagacattttcgttgcttccagtattacattattttcaactaaactataatgagcagcttcatgaata

SEQ ID NO: 400907 - DNA, 422 bp, Homo sapiens
cacgaggggtctcgaacccctgacctcgttatccactcgccgcggcctcccaaagtgctgggattacaggtgtgagccactgcgcccagcctaagtttttgaatttttagtagagacggggtttcactgtgttagccgggatggtctcgatctcctgacctcgtgatccgcccgccttggcctcccagagtgctgggattacaggtgtgaggcaccatgcccagccaccctcaaatatttgctgaatgaatggctatcgttctttgtcaaatccctttctcattaatcccatgcactgagtagaatggcatgaaatatgtttggtttctctgtctagtttgagttcctgagatctagttggtgagagacatgatgttctaccggttgctgtcgattgttggaagacaaagagccagcccagg

SEQ ID NO: 400908 - DNA, 241 bp, Homo sapiens
ggctaaatcccttattaatgccctaccaggagtgaatgaataaagccaagttaaaggagaactgggtaccagatactgtgctaggtttctttgcatgtaccctttcattctgctggagctaaagattttctgcctcctctccataaaacgcacccaaactccaaaaccaggaaattctccatagaaaataggagtgaagagagaaaagactaacaggataaaacccaaagcaggaagaaag

SEQ ID NO: 400909 - DNA, 516 bp, Homo sapiens
gtttggacaggcttcacatttcttccacaaaaccattctcctcctcttttaacctcgtctagacaaaaatggaaggtctatgccaccgcaatttaaaatcagaagagtcaggatttgttaaaaataagggggatttgagaatcacatttctgcatgaagattttaggaagggactgaaaccaacaacaattgagaatttctcttcacctgatttaaccactagcacaaaaaagtccacctaaatctttacaccaaaatctcatcaaaataacaaaactgtggctcacgcctataatcccagcactttgagaggccaagacgggcagatcacctgaggtcgagtttgagaccagcatggccaacatgttgaaaccctgtctctattaaatatataaaaattagctgggtgtggtggcagatgccttcttgggaggctgagacatgagaattgcttgaacctgggaggtggaggttgcagtaagctgagatcactccactgcactccagcttgggcaa

SEQ ID NO: 400910 - DNA, 500 bp, Homo sapiens
gcatacaagtccttggtgttttagaagtttgcccctgcttggatgtgagctgtcttcaagctttgttctacttaattgtataataagataactatgtctgatgtgatattatttaaaaacttggtgactgaaatatctaacccatgagcccatgctccataactttatgtgtttccaatccctgtgtgaatgttagattagcccttcaaaaaatccagagacatattagagatccactgactcaaacatctctggcttagaagcttagcaatcacagttgagagtgtgccaggataggagtaaagaacaccaaactctgctaacttggaggaaaactatgtatgtgtgtttgacccagctgaggtcaaggctggatgagatcatgttaatcatggccatgacatggataaagaagaacagagaccatgctcaaaacaggaagaaggagaagaggaagagataagtaaatttttgagataggaaatacaggtgaaattgag

SEQ ID NO: 400911 - DNA, 678 bp, Homo sapiens
  misc_feature (13)..(13): n is a, c, g, or t
  misc_feature (28)..(28): n is a, c, g, or t
  misc_feature (50)..(50): n is a, c, g, or t
  misc_feature (60)..(60): n is a, c, g, or t
tcccggcgttggncgaactagcactagnggatttcccgggctgttggaanttgcacgagncgctatgaagaggggaattaacaactatatatgaagagatcatgagagaggagagattaaggcaatacagacggaaagacagaaatgtcataagatccaaggaggtagagggaacacctgatacctgagttgctttctggaagccaaagaaccactattcctatggtttttcctttccattcactgtctattgtctcccagccttctttgcagattcttctctatttttcctttaaatattagtcttcttcattcagagctctgaccttgggctttcttcaacctattctctttccaaggggcatggccatggcttcccatactgccaatatactgatgaggcccagatattaatttctaggatctctctcctgagttcgagtcctgcttatccagatgcctggtgaatattgccgctccccaaatacattttactagccctcaaaatgaaattatctaaaatggaacttccctgtcaaaacttcccttttttttagtacttctttttggtgaaggaaaccctcagctgaaaaccaaaaatcatcctaggaagctctctccttttaattcacttaaacattgttatattcattctacctttttcatttcttttgactc

SEQ ID NO: 400912 - DNA, 381 bp, Homo sapiens
ttttttttttttgagacagggtctcactgcattgcctaggcttgtcttgaactcctgggctcaagcaatcctcgtgcctcggcctcccaaaatgctgggattgcaggcatgagccactgtgccaggccccctttatgtctatacataataaaacttaatcacataaaaggaggtatagggaaaatgagaagtacaagatggtattctgaggccacattaaaaaaagattgaaatttttaaaaatagccgaaatcattattgcttataccatctatacaagcatctagtggattctgcctaggcattacattgagatacagaaacaaaatcttctaaaatttcaatatcagaagtgccaagtcaactgtacttcaaattttc

SEQ ID NO: 400913 - DNA, 430 bp, Homo sapiens
caggctgattatttccacatgcgaactgcaagcatatgttatgcgtctctacttccaaatctaaatggtaccattttcattagaactctgagaaccatgttttgtctttttgaagtagatagttcacagacatctttgtttagtaaatacctccgtaagtttttccctcgcactttttaggcgttaataatgttattttttttttccttttatgccttctcactgttaaattccttgcactcactagaagaagctgcttccctagaaacaaaaggctcctggaagctgttactttgccactcacagtccacaggttgtgccttacaggaactttgatctggatagtagcctctggctgaagaccacagggctgtactctggagaggccctgcagtttatagcatttctctacacccctccgcttccccag

SEQ ID NO: 400914 - DNA, 565 bp, Homo sapiens
ttccagctctccccgaccgcagggctggggcgaccagaaaagccagactaatcaggacgagttcgggcgtggaattgggcctgaagccctcatgcccagccaggcctgaatgccccagaccccaccgtcacccccgtggcctggatggagcaggggacggccggcgaaggcgcggggtggaaggggagcggcgacgaaggcgcgaggagctgactgggaatccccaagctacccgaggcaagacactgaacttgagtcgcacttttcatgcctgtagaaatgagaatgacagctgtgataaaaaaaaaattcatctgggcggtatctggaacttggtaagcttaagaagagaaggggggggggaaacaccatgctagaactctgcgtttttaaacaaagcgaggcagggtcgttttctatccccttagccagatctaaggcggagccaaagaatgagtaccctgtaagagccgcctctatcgccgccccctgcccccggcccgctgaagaattaagaatacaaaaagctgaacccacagataaagcatttgcaatttaacttcca

SEQ ID NO: 400915 - DNA, 265 bp, Homo sapiens
tctgtccactcttcctaccacgaaactggtccaggccttgtcctcgtgtacctgcaccctcaggttaacctcctaacgagattccctgctctccatttcactgtcactccaagaactgctgccacacagctcctccctgcctgccttcctaccctgtctatgtccttccattctgggttttcctcccagtcttatttgcagatttctctttctctactgcctctttaaagggtggcattccttaggttttctttggcccttttca

SEQ ID NO: 400916 - DNA, 414 bp, Homo sapiens
agactcgaaagcactaataatcacaactttgtgagaattataccaccagagagcttgcttattgtaatagctaagaaaggatgctatgaatggatttaaatttttccttgaaacacttcacttccaggagatagatgctattctaatcagtttaagttggaaggggtttaatatagggtataacattgcctacagagggttaggaaaattaataaagtagtgtaaattgaatgtctaagtattacttccaaagccacacaacaaacctgggctgccaaggtgaccactgactattctatgatgagaaaagcttatacaatctggatatgactacatttgggataccgtaatgccccagtcaggaagccagttccaggactctgaaccacacctgttacaaaatgcatcagaaaa

SEQ ID NO: 400917 - DNA, 381 bp, Homo sapiens
aatggagataatcggtcaggtgcggcggctcacaactgtaatcccagcactttgggaggccgaggccggcagatcacttgaggtcaggagcttgagaccagccaggtcaacatggtgaaacccccatctctactaaaaatacaaaagttagccagatgtggtggcgtacacctgtaatcccaactactcgggaggctgaggcaggataatcccttgaactcgggaggtggaggttgcagtaagtcgagattgcaccactgtactccagtctgggcaacggaatgagattctgtctcaaaataaaataaagtggagataatcatagcacttgcctagcagggttgctgtgaggggcactgaggggatgtgtggtgaagctta

SEQ ID NO: 400918 - DNA, 450 bp, Homo sapiens
aggctcacttggcatgcattcagccaccaagagagaagattttcttaccagccatctgccctggcccccatgaagagatcagtagcctgagagcagggagatgtccatgtgggcctccccaggcccctgtgcagagcgacaaggattttcacccctcctggtttgcctgagtcagactttgaaggagccatcactagggatttttatgaaattctttagttctctgggaatggagccctcccaccactcccaatgccatgtaagtctaaacttgagtgtgtgaattgcacgcacatttttggaaagtttgatgaatgaaaataagaagctgctattattctttggaagtcccaattctgagtcccttcactattcaggccacccttgggttcagtttgtccagattccacttagccatcttgctacttattgggtgacatttgtcataaa

SEQ ID NO: 400919 - DNA, 334 bp, Homo sapiens
acatgttaggaagttaggcctggaaacagatgatccaacatatagatggtaattgaaacaaggattccctagggagatcatgtaggatgggaaaaagatggaatccctgatgaactccaaaaatcaagaagtagctgtagtagaggtgagaaattgtatttccttaaagaattggggtggaggatgccagatggagaatgttaagggcagtataggactgcttatcctctttatttagatttaattcccttaaatcttctctttagaaataacatgttaaggattgagcttatttttctgcattaaaaaaattttaccgctcttttccagactt

SEQ ID NO: 400920 - DNA, 279 bp, Homo sapiens
tggcagccactgggcacatgtgacttatttaaataaaatgtacagttcagttccagttatgctgccacattccaagtactcaacagtcacatgtggctggtgatcgccaaaatggaaaagtgcagatatagaacatttctactattatataaaattctaccgggcagtgcggggattacaggtgtgagccactgtgcccggcctagaacctactcttaagcacagtaggtagtccatatcttgatacttgtgttcccaattaagtatgggaaatggtct

SEQ ID NO: 400921 - DNA, 426 bp, Homo sapiens
ttagaatcagtgggagctctgagcttgttttcctgcaactaggtggtcctctctgggggtgatgagagacagtgacagatcgtcaggcattagattctcataaggagcgcacaacctagatccctcacatgcgcagttcacaatagggttcatgcttttataagaatctaatactgcagctgatctgataggaggtggagctcaggtggtaatgcgagcaatggggagcagctgtaaatacagatgaagctttggcttgcttgcctgctgctcacctcctgttcagcccagttcctaacaggccatggactggtacccatctgtgacccggggtttggggaaccttgttctagtctttccctttactctgttgccagatcaatctttttgaagccttgctctgatcaagccactccgctgctaaaa

SEQ ID NO: 400922 - DNA, 270 bp, Homo sapiens
agtaacaaatgtctctgagtcaaatctctcttctgaccagccacactgaatgagataatttgtcatttcaatttaagtgtttgtgtgatgatgagaatactgaaaatgtgacttttaaagcacttgatgatactttgaattctttagtttttgtagttttggtccaaatttgcttgctttatttcctcataggtaatgaaaatataaatccttagcctaacacttttgcaaattatttcaaaatgagaataaatgaagtttaaattcatt

SEQ ID NO: 400923 - DNA, 357 bp, Homo sapiens
caaaaaatgaggagattggattaagaatttgtaggattccttacaactcaaaagttatggagaaaaatatctataggctgaaaattgttctaagctgcaaaaatggccttgagtaacttcagaaaataaacattaaagcaaatcatcttttatatcccttttttgaatgttttatttatttaatatcaatcaaaatactgtaatagattaaataaatcaaaacacatataatcttgtctagaagcagctttggactaaaaattttcttcgcaaaatattaaaggtgtgacttttaaagaaaatctcttaatacaggacctaaccccattttatatagcattaagttaatataactgt

SEQ ID NO: 400924 - DNA, 1194 bp, Homo sapiens
  misc_feature (633)..(633): n is a, c, g, or t
  misc_feature (635)..(635): n is a, c, g, or t
gaaaatgattttgttacatttcctttgaacttttcttttaaaatttgtttttatttggttgaaaataattttcataactactgatattttatattagtagaatggtttcttgattcgtctgtataaaatacaaatctaagaaccctgctacagtaagttactctaaatctatttgatcttaatttagaagagtaagataatctttaggccatgttggatgtgttctggtcagaaaacatgtagatttcatacctcagtcctcatcccatgagtgtctgatgaagcttaaatcttcctgcaagaaagacttgaatgattttaaacatgagagacactgtatttagtggtaacatcttaattttagtgttaaattgtattgcctaagaagaacatctagggcgggcgtggcggctcacgcctgtaatcccagcactttgggaggccgaggcgggtggatcacgaggtcaggagatcaagaccatcctggctaacacggtgaaaccccgcctctacaaaaaatacaaaaaaattagctgggcgtggtagcgggcgcctgtagtcccagccccttgggaagctgaggcaggagaatggcgtgaacccgggaggcggagcttgcagtgagccaatatngnccactgcactccagcctgggcgacagagcgagactccgtctcaaaaaaaaaaaaaggaagaacttctaaatctggctcctcttatgatgaaccacttagacttaactagggtacggggggccaggggaagtcatcatgttctggaaattccattaatgtacatcatcctagtgtcaggtaatgtggtaaatccctgtactttaagaaagggtggccgggcatgggggtcaggcctgtaaccctaaccttggggagacgagatgggggccacctgaggtcagagtcaagacaaggcgtgggagtggtaaacccattttgtgtaagaataaaaaattaagtgggatggtggggctgctgaatccagctactcggaggtcggggttgggatggttggccgggtgcaggtggtgaccgaatctgctgtcaggggaaagagggtcgtcaaaaaaaaaaaagtgttaaggggggaattccgggacgtagacttttaaggctaggggttaaagcggggaaaggaagtgttagtcttgggccaacaatatgttaggatgtaaaattt

SEQ ID NO: 400925 - DNA, 414 bp, Homo sapiens
cttaatgaagacttcagcctttaggggtaaataaaacatcactaaacagggatggcttgaatatttcttaccggctgtaataattaaagccatgaaaaaggtggtggggttatgttactcattaactggaatcgctcttagatttgatcaagacgcggtggcccctggcgctttgtttcatgtttgtcctttgtttcattgacacgctttgcctcggcctccgtggcgctataaaagcagcagagcagttaaagaaccggacccagaaggcccgtagacctcctatctagccgccttttctcccctccccccaaacccaacaaactcttcaaccttcagaactgagcctgaaatcatctataaagcagcacacttagggatctgggagggaacgggaagaaaccttcctctttt

SEQ ID NO: 400926 - DNA, 361 bp, Homo sapiens
atggggtttcaccatggtctcgatctcctgacctcgtgatccaccagcctcggcctcccaaagtgctgggattacaggcgtgagccaccgtgcccggcgagttcttaaatatagtttttaatgtctgttttgggctgatttttaagtgtacttatgtattttattttaaaaaggtacagatagtgttaagttttttcttttgattattcccaacagctaatttgtattagagataattttcttatctaattaacctattttattttaaataggggctgataatcgtagggctcttgaatactataaattttgaggtcatcctgtggatatatatcagaaaggaagaaacaagttatcattt

SEQ ID NO: 400927 - DNA, 452 bp, Homo sapiens
gggggcgctgtacacagggccgccttcctccagcttcttgttcttgtccttcaaggacttgagggacttctctactaccgagtcatcaccaacagggcgcgaagagtgccagccgcgggcaggaaggcaccgaggccccaggaccacaaaacccacagaggtggaggtccatggcgctctcgacacggtgcgaaggcactcgggcctcagagtccaacagctgaggtgatcgcctctgaagcacgggtaggcagggtgggtgggagtgcagcagccaaatgaaactttcgggcagctcctcaaccccagggtgctggcaagctgagatgagcaggatcccccggactaccccgcggggcggtgacccgaggcggcggcgggaggctggcgggcgcccagccgcggcagctcctcagtaagatggacgccgtgtgtccgggcgtggcggccgc

SEQ ID NO: 400928 - DNA, 425 bp, Homo sapiens
aggaaactacaacatttcactgggatgtcacatgagccagagtggctggaaataagtgatgaggggcttctatgcatagagcgtcttctatgctgtgccaaagaacttgaacttttatactaatggatatggggagccacttaactttaagcaggggactgagatgagtagatttccagcacagaaaaaaataacttgggcaaatgtggaggggcaaggctggcaagcagccccaaaccgtagtctagaagattgccccaagtgactactcgatggaggcatcattcactgatatgggacaaacaggaagagaaatgctctatcagaagggtcattctgcgacactggccatagctgagcaacatgaaagatttatgctagaaatggaacagaagggccggcttcagacaagcttgactgaacca

SEQ ID NO: 400929 - DNA, 606 bp, Homo sapiens
ccaaaacctcctttgtgccatcacagtcccctctctgcccctctgtcatcacccaccactgccctctgtcatcagccactactgctgtgatttctgtcaccataggtaaatttgggccttcatttttgaatatttgagggtaatgtatatggtccaaatcactctcccaacacaaccaactaactgaagaccaactctaatattataagaaattggaatttaagtaagaacaatgccattttattttaaacacacacagttgcgtccaaatctaacctcttccttcaggagtaaggagagaagatgtgttgtcttctagaatttccttcataaccagaacttcatgtcagttaaaaatttctgccatgaaaaaaaactcaaggaatcaagaaagagcctcaatgtcttcgaacaaatatcacgtctcctcagatcttccatgtcatattcccctttgttgttctcaacaaaaacagagacttcccatcttaaaaatgtatatgtgatgtcttattaaaaaaaaaaacatgttattagccctgctttcaaataaccctctaaagttgtatacttgagggcagaggcccttgtggtggggttgtggga

SEQ ID NO: 400930 - DNA, 452 bp, Homo sapiens
aaggaagtgggctgctcctgcaggacccgggagacccccgcaaaagtctgaatgcaacagcccctggtttcctgctctgtgaggaatggctagaccacatctcctgctggtgacaagtgtcagaagtattgattctgcaacaaactgagaagaaacctggcgattcacaacagagagctgagaaatcctaagtctggattccagctaaatgggagcagactaaatagagcggcagtcggcgaactacatgtagcccatgaacaaaatccggtccagcacgtgtgtttttttttacggcccacaaatgagtctgtctttacagatgaatgttaaaactgggttgacaagagagaacactcactttgaaccgcaactaaacaaaatattatcacctttcccctcaaaaaaggtttttgttcttctcattagtaaatttgtattatgacaaaatc

SEQ ID NO: 400931 - DNA, 383 bp, Homo sapiens
gctgcaaagctctttattatctttttgccactatataaatatggaaattgaaaatagtattgattctgcaacaaactgagaagaaacctggcgattcacaacagagagctgagaaatcctaagtctggattccagctaaatgggagcagactaaatagagcggcagtcggcgaactacatgtagcccatgaacaaaatccggtccagcacgtgtgtttttttttacggcccacaaatgagtctgtctttacagatgaatgttaaaactgggttgacaagagagaacactcactttgaaccgcaactaaacaaaatattatcacctttcccctcaaaaaaggtttttgttcttctcattagtaaatttgtattatgacaaaatc

SEQ ID NO: 400932 - DNA, 1021 bp, Homo sapiens
ctttgagccatgataatgttactggttggatgtcaggagcaggccatgtggatgattaaaagatgaatatcatatacagcatggatatgttggacaaaaagatgattcacatcccagacagaatggagcagcacatttattaaaagccagaagctagaagacgaggaaagaagaggtggttaaagaaagatacagtaacagcagtaatatctaacaggaaggctacaggggaaaatacagaaattccataaagaacaaacactgtaactcaaaaccaaagctttgctagtcactagtgcccgctacatcctaacaggtgccgcgtatttaattgtgaagtctttaacaatcacaagaatatctctgaatcattaagagaatgttgaaaaatagccacataaagaaagcaataaaggagctaaatgacttagtagaaaaacagactttataaataagtttaattttccaaatattttattgcttaagaaagtgacttccctgatttggagaatttagttccaagaagggattcatttcctagtgatgttgagggttgctctgcccaggtacccttaagatatataattggagaattttttattagtatgacacaaagagactcagccttaataagaattttatgctcaacatgaaattaatattttgcttttgaaatagtgtagtgccattattttactcttaacatttaacaattttttttaaaagaaagtaacacgccatttttatttcttgttaaaataatgttaattgtaaaaatgtagacagtggggagaaaaatcattcatagtcccaccagcaaaagacaaacactgttaaaacgtatgtgtgttattttagcctcttttttttttttacattgctatgctcttctaaagattcctcaggttatctaatttttattatcgatagcaactaaagttattaccctttgtgtttccaaatgtgtgtaacatctcaataatgtgctttaaaagaataaattatttcaatatccatgaac

SEQ ID NO: 400933 - DNA, 1242 bp, Homo sapiens
ctttgagccatgataatgttactggttggatgtcaggagcaggccatgtggatgattaaaagatgaatatcatatacagcatggatatgttggacaaaaagatgattcacatcccagacagaatggagcagcacatttattaaaagccagaagctagaagacgaggaaagaagagatgcagctggagagcctggggtgagaacatgagcagtctataatcagaaaatccctttgggataaattgacaaaaatataaaccactccacaaaggagaaattgtaaatgagttgttatgtaaaacctcccagcgaaagaaatagtccagaaagcttgaagagaaactgaaatttgaaaaatctacctaaaaaggtgataaaggattttcagttttgcaaaaaacgcaatacagagtgtctttggaaagaaagttctcatatggatttaaaatatgattcaatttacagaagtcagagttgttcttccagatggcatgaatccaacagtgaagaaatcagaatacgttgcttttgtgaggggcagctgctgattttctctgagctccgtttccagccttcacatgctctgctattcatcacagggtaaattctgactataggaggtactgacagaagattagggaagaacagagggctaaatgtttattgacttcttgaaaaatgctatgtgtcttgccagacttagcttacaagtttggttaaagagagactgacatgagcataaaggaagggacattgaaagaggcagagatgaaggaagaaattgtaacttactccttttatcccacccatcaaaggaaagacaagttgacattcccagggtggatggatccaggcaggacaggatcagaagttgcagtcttaattgcaccaactcacgcatgtcaccagccgagtagtattgattctgcaacaaactgagaagaaacctggcgattcacaacagagagctgagaaatcctaagtctggattccagctaaatgggagcagactaaatagagcggcagtcggcgaactacatgtagcccatgaacaaaatccggtccagcacgtgtgtttttttttacggcccacaaatgagtctgtctttacagatgaatgttaaaactgggttgacaagagagaacactcactttgaaccgcaactaaacaaaatattatcacctttcccctcaaaaaaggtttttgttcttctcattagtaaatttgtattatgacaaaatc

SEQ ID NO: 400934 - DNA, 609 bp, Homo sapiens
ggtttactgtactccagattggtttatacctaggaagataattctcactttattaatttccaatgtgtatgatttagtgatatctaaaccaaatctttaccccacctttaggcgtctcactctgagaattctttgtatgatacagacagatatgattccaaccaaatctggttgctttattctaagtgccaaatctaaacctgcctttctatgtacacatttaaaaacaaatagaaagacaaggcttaacccttacatgttattcctttttttttttttaaatatactgtgaagaaatggttgagctgtcaggcaaaaacagacaaatggaaagatgtgaggtcataatggactcttgttttcttgtccttttaaaagcagttgtgatttcaaagtatttgatggtggcatagaaacttttccaaagcaaaaaacaaaaacaaaaaacttacttttcaagccctataaaacatgtcttctctgattccctggctgtgatactgacagtctttgccttccccttaaataggaagtactagtattgtcaccagtcttggcagcccttgtctcctttacatgtcaatgcaagtaaaagcatgttacactctc

SEQ ID NO: 400935 - DNA, 825 bp, Homo sapiens
atggggaaagccctctggaactggagcagctggaccagcaccatgagatgaaggtagagcatgagactagctcatgagcagggaaaaccctgcctattcgattgttgtcttaaaactctttatttattgcacccctgaaatgtatgaatcagatcacccacactggcagttaaacgattttcaagctctggctgctgattagcatttcccctatgctctaagcagatatttcactttttcttttcatgtagtttctgttaatatctctgttgtaatttcaggagtcagaacagtgtggaaactttaatataggaaatccacaaatgtattgtttttacatagaaagaaaatgttccttgttgctctagatgttggtgctgtatccctaatacttacgggccaagcaagaagaaattgtataatctttgttgttcagaagtttctaatagaataaataggcctgtaagatgaacttgccactagtaaatgttacttttaaggacatgaatatggaagtataaagcgttgagctcaacgctttatacttcgtgcatttagttgagtatttgttctgctcataatttccaatatgtaccagaccttccctgtgttcagcacctccatgacagtatttctgttttctgagcccttgctctaaacagagtattttgaccactgaaaacatcccagaaccctgctgcagaaggccagtgagggtggtcccactgcacagtgatcccctctgtgcatctgctcagccgaggctgccagcgatctgaataaacctccctactagcgtcaggtcttgaagtataaagcgttgag

SEQ ID NO: 400936 - DNA, 688 bp, Homo sapiens
cagtgtcaccaaaaggctaaaagtcttaaactaatttattttcactggatatatttcatctgctgctataatcaaacatgatttaatgaacttaacatcaataaaatattttgccttgcttgcataacaaataagccacttggaaacttattctggttgtagtctcattttcactttttattattttaaagaaattgtgctgtgatgagatattctgttttaaattttctaatttttcttgtcattgcttttgtgtaagttggaaaagatgtgatgagtgcttaatctattatattgtttggagtgtcaacatgtaataaacacaatgctttctcctctgctttgtttgttttgtgctgctataacagaatgctacagactgtgtaatttatgatgaacagaaatttatttggctcacacctctggaggctgggaagttaaatatcaaggggccaacatccagcaagggcatttttttgctgtgccatcccgtggtggaaggtgacagggcaagagccagagagcaagagaagcccaaactcacttttataacaaacccactctcacaataactaaccactccctcaataactaacccactcctacgataacaacattaatctatttatgcagagccctcatgatctactaattacatcttattaggccccaccttccaacactgttg

SEQ ID NO: 400937 - DNA, 362 bp, Homo sapiens
tgagcagtatcaagctgtcatccagtgggtgcagagaccgacccccactcctggaactaactccctgagctcactggccaaacaagaactgctgaggtctcagagtcctaacctgtaaaatgggtacaaagttggaacaagacagtctatggaagccctccaactctgacagcctgaagaatccaggtatcctccttcaacagagaacttagcatttcctaatccattttgcctcccctaaaagtcctacttggcagttcatcccattgtctgctttctggggctagtttgtctcacccaattactagatgaaggaaaaatgattttttgattgggaacatcctaattttaacataaattca

SEQ ID NO: 400938 - DNA, 477 bp, Homo sapiens
gattacaggagcacaccacagtgcctggctttatcctgataatttaccctaaggaagaaatcagacaactgtgctagactatacttacagaaggcagtttatcatagcgttgatgatggtagatgaaatgtggaaagaatctcaatgttcagcaacaggagactggctaagacatcatgccacagctatgcaagggacagatacacggccattcaaaacagtgaccctcctgattgaatcaaatcccctatcaccactctcacagcaccacagatctctctcctttgtagcatttattaccatcataattttacatttctttgtgaatttctttgatgaatttctatctccttcattggacgctaagctctgtgaaggcaaggactctattacgttcattattgtgccctcagtgcttagttaagttcctggaacacagtatcctctcaataaattgttgttaaatgagtgagtgag

SEQ ID NO: 400939 - DNA, 437 bp, Homo sapiens
gtctagttctttttaaaaaaaattagtggtatgtttattggaatcccattaaatttataaattacctaatttctttttaaaatataagggttaagtctaactaaccataccatcacctctctttttgtgtcctttaattatctcccaagttttctttatgtgactcttgtacattttttgttgagtatttctaggtattaaacttgctgctgctgttgggctttttccacattttgtcttctgttttgtaccctgctaccttactgcattgtcttcatgttttatcagtttctcagtacattcttaggagttttccagctgtgtaattatactgtctgtagttattaatggttttaccttctatccagtctttataactgaagcttctttctcttttctacctactttatttatttattttttggttgggcggggga

SEQ ID NO: 400940 - DNA, 461 bp, Homo sapiens
tcgagtaggggctcagaaagctgtgaaactcactcatttcctgcatcaggacttactttggtcctggataaataatattgaagatatatacttaaaatattcctaacatcagaatttgtccatgtgttttcttcctcaagaaagtgggatcaaagccagaaaggcatggagtcagaagaaaataggagggagttaatacatattatataacatattacgacccccaaggcagcagatcacttcagcccagaagtctgagaccagctgggcaacgtctcgaaaccccgtctctacaaaaaataacaaaaaaattagctgggcatggtgacctgcacctgtattcccagctactctgtgggggtgggggaggctgaggtgggagatagaggctgtactgagccacgattgcgccactgcactccagcctgctccagacagagcaaggccctgtctcaaaaaaa

SEQ ID NO: 400941 - DNA, 381 bp, Homo sapiens
tctggaccccatccctcctccctggttccacccagggctaggctctcccatctgccccggccaccccagagacagacgttcaagctgaggcatcaggagattcaagatggcttttctggagagtttcagtttgaaagagcagcctgctcaagaaagtaaatccctaatagtggactgtggtggtggtggtggcattttcaatttgattattgctggaacataggaaaggcctacattagcttgttgctattgtaacctagccagcatgctaaattccttcattaattttaatcatttgccaaataatgttcttgggtatccaagtagaaggttgtaccatctgctaataaaacaattttcttcctttccagtacctatgca

SEQ ID NO: 400942 - DNA, 480 bp, Homo sapiens
ggatttatttatgattttctttcttcatctgtcgagcatattaaactgcttaacagcatcaacctgaaatggatcttaatgtgcaggggatttaactctttttattgtaaagttgtggataaaatatttaatagatatggatgaggactcatatcagtaacaacccaatactttatttcaaaatgaatagatctgtattacaatcacttgtgttgtgtgcagtagattttttccctttaacttaggaagcagttaataattaatggctccattttttagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggtaaggaaatcaatttgaatgttttcaattgtaacactaaagaaatttaaactt

SEQ ID NO: 400943 - DNA, 386 bp, Homo sapiens
aatcgcttgagcctcggaggtcgaggttgcagtgagtggagattgcgccattgcactccagcctgggcgacagagctagacgcagtctcaaaaaccaaaagcaagcaaacctgtgggaacaagtcctaactgatggggatgtgtctgaattagatgaagcatataaattgcctagcaaactgcctgatgtggtaccttaagaaaggcctcaataaatgttaatctcttccccttgatgatttaagttacacggtttagattcatattcaatattggtttttctctagatttcttctatttttacatacaaatatgtgtttcatttgtgacttagtgtttcattttttaataacaaaaataaaaatctggcaagcattgaaaaaact

SEQ ID NO: 400944 - DNA, 294 bp, Homo sapiens
acgaggctgcacccttggcgtaaagaacacctgacatggctgaaagcttggtggaaagaacacctgaggaataggatacagcgaattccttttcaaagattttagcctgtaaaaatcctttaaaattcaagagggggaagattaagtacaatgagttctgagttcctcatcaaagagtaaatatgtcagtatgttcagcttctctgttctttgttctccgttttaaagtttaacttcctcattatttatgcctccttgcccctagtttcattaaacaacccccttctaacctct

SEQ ID NO: 400945 - DNA, 698 bp, Homo sapiens
ggcaatgtcttttctttctacagttattaatattttttcattattcttaatattctggggtttattataaatctagatgtcattcatttttatttatcttgcttagggcttaaaatatactttgaatatgatgattcacatcttcatttctaaaaagtcttcagctattatattctcaaatattgcttctccactattctcgcaattctatttctccagaactccctttacatgtcagttgacacatctcaacttatcctctgcgtcatttaactgctgattaattgatagatacattcttctttttcctgctctatgtgcatcagaactattcactaaaacattaactaagttcctcatcaactgggttcaatctaagagttccaggtatggaattatttcagtagctattttttattccaagttttatatttagttcttttattctgcctattttctgtcatagtttattatttcttcactgacctctttgaacatcctaaacacacattttaaaatgcttttgtttgttataaaaaattaactcgagtcaatttatatttcatttcttcatattgttgcctcctttctttccattattcatattctttagaatttgagtttgcaggctcattttcacagttgcacacacatgggtgtgtcaccttgggcagaaggcaagaagagagaagcacttt

SEQ ID NO: 400946 - DNA, 329 bp, Homo sapiens
gaggctactcctttaaagagaactatctgtggcctttacctttatgattccaccgctccgtctgttcccctcccatgcaagggggaacatggaactaaattaagaactggttgtcccgaattgtctcttcctacacttcagaaagatagtttatttcctggaaggctgaggggcttctcctgctgtctcccattggtggcgatggactgtagtatttaacagcattgctgtccaatgcggagcaggaatccacctaccttaactcttcctaattaagggtgttctggagaaagtcccaatggcagtgctattagtgattccaagcctgc

SEQ ID NO: 400947 - DNA, 638 bp, Homo sapiens
tggtgaatggctgtaatcccagctactcaggaggctgaggcaggagaatcgcttgaacctgggaggcggaggttgcggtgagctgcgatcacgccattgcactccggtctgggcaacgagagcggaactccgtctcaaaaaaaaaaaaaaaaaaaaattaggagttacttacatgtctattacgaaggctaatgttttgtgttagataagatctctgtctgatgtatcctatgttacttacagtatgtatatgtatccagagcagttaagagtttcagctactatttgaccttgggaactttaaaatggacttcacgtttatataaacacttatttttcttgttttgaaaagaaggtaacatcaacctcctggagatgggatgaggactaaatgagatgaatgttaaagaaactgttggccgggcacggtgactcatgtctgtaatcccagcactttgggacgccaaggcgagtggatcacctaaggtcaggagttgaagaccagcctggccaacatggtgaaaccctgtctcgactaaaaatacaaaaattagctgggcatggtggtgggtgcctgtaatcccagatactcaggaggctgaggcaggagaattgcttgaactgggaggccgaggttg

SEQ ID NO: 400948 - DNA, 513 bp, Homo sapiens
gagtcttgctctgttgcccaggctggagtgccatgtcacaatcatggctcactgctgccacggcctcccggggctcaatccatctgtctacctcagcctcctgagcagctgtgactacaggtgcacaccaccgtgcctggctaatttttatatttttttcgtagagacagggttttgccacattgcccaggctggtctctaactcttaggttcaagcaatccacctgcctctgcctcccaaagtgctgagattataagcgtgagccactgtgcccgaccaccaattacaggcatttttaccgttcttttaccaatgcctcaaatggcataacaacttcaattgctcaaacattttgcccactttaagaatgggcttccttcttaataactgaggcatatgagttcttcaaatattctacataaaagtcctctgacaaatacatgtctggcaaatattttctcttattctatagcttgcccttttattttcaaaacagtttttgaaagaacaag

SEQ ID NO: 400949 - DNA, 354 bp, Homo sapiens
tctctttccaatgtctatttctgttagaatatggaacttgtaaagaaaagtatttgcaaacatttaataacattcttagggatatttctgtttggctgtcttcacatttctattaaggaagctcagctgggcgcggtggctcacgcctgtaatcccatcactttgggaggccaaggcaggtggatcacgaggtcaggagatcgagaccatcctggctaacatggtgaaaccctatctctactaaaaatacaaaaaattagccgggcgtggtggcaggcgcctgtagtcccagctccttgggaggctgaggcaggagaatggcgtgaacccaggaggcggagcttgcagtgagcc

SEQ ID NO: 400950 - DNA, 325 bp, Homo sapiens
gaattcaagtttattttgaaaaaatgcacaccaatacagaaatatagagaggaaaatggcaactcatcctcctcaccacaccaccagctccagtctcatgcctctggaccaagttccaacaggtaacaaaaagccacaggcagaactgatacctgaactctatgacatttgccatgtgagtctgaaaatgggatgacaaaactaagacatgccatctcctcattttcatgctgaaaagaaattaaagagaatctgcacaagagttacatttttcaataatgttttactactggaataaataaactatactttttaaaaaatataa

SEQ ID NO: 400951 - DNA, 379 bp, Homo sapiens
agatggatcatgtacaaaacactatctttattgatattaacatattatttggggtatctcatccagtacctgtgggatggtattgtttctggtctgtcaaatatatgactttgaaacattttaacacaggtcaaaaataggaatgtatttaatgaaatctctctctatgacctcttttctccttgtttccagcatacattatcccttgctcatctctctccttcagttaatttagtcactgcttaagaaaacctaggtcaggcccagtggctcacacctgtaacatcaacactttgcaaggccgaggtggaaggactgtttaagcccaggagttcgagaccaacctggacaacttggtgaaaccccatctgtattaaaa

SEQ ID NO: 400952 - DNA, 262 bp, Homo sapiens
ttcctctcctcccacctccaggctaatggtgggcaggcacctgacccattaatcaggaagtctcaagcactaaggaagctcacagttacgtggaacatgttcaaaactagtttctacatggcatattattataaagtgctgtggcccctggggaagtatgagttgaggactgttagtcccaactgttggagaattggactttgaagagcagtggaatcttgctaagtggaaactaaagacttaggaggtgggaggagaggaa

SEQ ID NO: 400953 - DNA, 421 bp, Homo sapiens
ttcctctcctcccacctccaggctaatggtgggcaggcacctgacccattaatcaggaagtctcaagcactaaggaagctcacagttacgtggaacatgttcaaaactagtttctacatggcatattattataaagtgctgtggcccctggggaagtatgagttgaggactgttagtcccaactgttggagaattggactttgaagagcagtggaatcttgctaagtggaaatgaggggtttggtgaattcagttggtatgtgtctaaaatattctgcagtcccttgcccctctaaggcttgctttctgtgttcttagaccctttggactgagtacaaaccatatcccagagatccaaagctggctatgggtcacgctagggtatggtggctggtaataaagaagtagaccatatctgaaa

SEQ ID NO: 400954 - DNA, 403 bp, Homo sapiens
ctttccttgctcaggtagctggaaggcagtcctctgtcagagagacccaggtattgattgtaggcagggaaagcacactggtatccaaggtgtacaaaaatgacaaagggggccgggcacagtggcttatgcctgtaatcccagcactttgggaggccgaggcaggtggatcacctgaggtcaggagttcgagaccaacctggccaacatagtgaaaccccgtctctactaaaaatacaaaaaaattggttgggtgtggtggcaggtgcctgtaatcccagctacttgggaggcttaggcaggagaatcacttgaacctggtaggcggaggttgcagtgagccgagtccgtgccattgcactccagcctgggcaacaagaatgaaactccgtctaaaaagaaa

SEQ ID NO: 400955 - DNA, 1452 bp, Homo sapiens
agacaatctgtgaagaaagtgaacaaggcagatggagataaattcaaaaacagagatccgaaaggctgctaagagagaaaggaacaggaatctcccagttcctgagagcctcccaggctttctccctcgatgtttggagttttatgcctatgtaatcagtgcagacagccgttaagtaaatgaagaggcaactaacaatgtcagaaaagagaccgggcggttccggctgacactaccctaatcttccaggacccattaaatgaaaatttggaaaacaggcttttcctatccggatgaacagagataatttgtgtcgatggatgttctgtgaaggcctattgtgtcgagcagcgtattaaaacataaacatggctcttcccccaagaaacttacatttcagtaagggagcctggccaaaatggaaaactgcaaggttcaaatcctggagtgcagaagaagcattaggcattgaccctgtggcttcctaatagatccgcaaagtgctttgttcctggaaatcatccgatgagtagttcagtgctattgtatatcttgttagagcagccgaagtgccacaaaatgaactaaaatctccctgcagagttgctgtatcatatgctgagaacattcggaactttcaacaaattcatgttacgatcctgggtagccatggttaaatctgtacaggggttaaatgagaaatatgagcctgctgttaagtgtcttctgagagtgacaaagctctggccataagggatgggagaggagggatttcttctcagccttccagccctttccagctgtatcacagacaggagacataatgcaaaggggctcagacattgacttcctggatctttgcggccccaggcattgaccccctctacctggcttttcctacgctgtaaaatgaggatcctcctatattatggagtttattgtgacaactaaatagctgagaagaaggacatctcatttgttttaactatgcagtttcctgtctatctatctatctatcccatcaatctatcaatcaatctatcaatctatctgtctatccctatctatctatccatctatctatatctgtctatatctatctaacatttatctatcatctattcatctatcagctatcatctgtctatcaatatttcaatcaatctctctatccctatcaattaatctatctacctacctatcaactatccatctatctctatcatctatcatctattcatctatcatttatcatctgtcaatccatcttcctactatctatcaaaagcaacacattttcttcctgactttaaaaatatttaagtgggccgggaggatggctcacgcctgtaatcccagcactttgggaggcctaggcgggcggatcacgaggtcaggagatggagaccatcctggctaacatggtgaaaccccgtctctactaaaaataca

SEQ ID NO: 400956 - DNA, 660 bp, Homo sapiens
agacaatctgtgaagaaagtgaacaaggcagatggagataaattcaaaaacagagatccgaaaggctgctaagagagaaaggaacaggaatctcccagttcctgagagcctcccaggctttctccctcgatgtttggagttttatgcctatgtaatcagtgcagacagccgttaagtaaatgaagaggcaactaacaatgtcagaaaagagaccgggcggttccggctgacactaccctaatcttccaggacccattaaatggtagtttcaacgcattacctaccataacatccttgaatatcactgattttatttgcagtatcaaacattccatttcatgccccattaacagtgggagcctgggctttttgacgcagctaaacattttactaactacctggactaagtaaccaattaacttttggagacaatacggccaattaagcgcgaaaagaaaatttggaaaacaggcttttcctatccggatgaacagagataatttgtgtcgatggatgttctgtgaaggcctattgtgtcgagcagcgtattaaaacataaacatggctcttcccccaagaaacttacatttcagtaaggggtatgtatattccagtgaagtgtacaaacaataataaaaggtgtgtttaatgatcctttaa

SEQ ID NO: 400957 - DNA, 481 bp, Homo sapiens
actactactttgatattctaggtgatttcaataaatacataaatgatcttttaaacaccttaaactcctcccgaccctacttctagcactcatagtcacagtctaaccttgtcattacaacggctgcaacctctataattttggccttgtacatctcactctctgatcaccacctcatccaccttcctttccacttcacttcctctagtatcctgactttaacagttttcctattccatggggattccagtctactcatctaccacttttcactgccccttgtcctcttgatgtcctctcttcactttcttgccaaattacctgccatttgatcattataattatttccttgtgcctgggcatggtggctcacgcctgtaatcccagcattttgagaggccgaagtgggcagaacaccttagctcaggagtttgagaccagcctgggcaacatgctgaaacctcatctttacaaaaaaata

SEQ ID NO: 400958 - DNA, 461 bp, Homo sapiens
gttgatgtttggttatttatattgagaaaagaagtgagaagatgtcataattagttaactactcagtcctgcagttatcatcaaaatggaaacagggaccaatgcccaagtaatatccaaccttttctttaaattttgatatgtctgcagggaaggaaataagagtccatggttaggctgggcgtggtggctcatgcctgtaatcccagcactttgggaggctgaggcgggtggatcacctgaggtcaggagttcgagaccagcctggcaaacatggtgaaaccccatctctactgaaaatacaaaaattagccgggcatggtggcctggcctatagtcccagctactcaggaggatgaggcagcagaatcgcttgaacccgggaggcagaaacctctgcagtgagccaaaatggcaccactgcactccagcctgggtgacagagtgagactccgtctaaa

SEQ ID NO: 400959 - DNA, 728 bp, Homo sapiens
ccgctctccacccacccctggtctgtgtctgtttttatgccagcaccatgctatagctctggagtataatttgaagtcacataatgtatgtaatgtgattccttcagttttgttctttttgcccaggattgctttgcctactctgggtctttgtggttccacaaaaattttaggattgtttttccaaccctaaaacataattctctgaagaatgtcattggtgttttgacaagggttgcaatgaatcatgtaaattcctttggggtagtgtgcagagcgattttaacaacactgattccaacaatactgaatccatgaccatggagtatctttccactttttggtgccgtcttcaatatctttcatcagtgttttatagttttcattgtagaaatctttcacttctttggttaagtttattcctaggtattttattttattttatttgtagctattggaaataagattattttcttggtttattttctagattgtttgctcttggcatacagaaatgctgctgatttttatatgctgactttgcatcctgcaattttactaaacctcagttctaacagttttctggtagagtccttaggtttttctaaatttaagatactattgtctgcaaacaagggtaatctaaatttttccttccaatttggatgccttttcttttcttctcctgtttaattgctctggctaggacttccagtaccacgttgaag

SEQ ID NO: 400960 - DNA, 173 bp, Homo sapiens
cacagttagaggacaatgcaggcctggcccaactctctgctctttattttgaatcctacattttcctttccgaaacaccttggaagccacttagccaaggtaagaggaaaagaaaaaggcagctatctggcaggcctgcctgcacagagcaagagctttgctgggccatttga

SEQ ID NO: 400961 - DNA, 370 bp, Homo sapiens
ctcttttttttttttgagatgactaaagaaaataatatccatgctattatacacatgaaggtaattaatatctgattgtgttatattttataattatgtgattacataaaaattccgtaattatagatagaaaaatatgcccaggtgaaatgttttccaaaaaaacaagagttggcctatttcctaaggccggggaagaattgagcaaaaaccacatgaatgaagccagaagcaggggcaacagagcacgacaacaaacaactgactttgcgttcaataaagctctgtgcatgcagggatccgcagcgcgccccataagcggcaggaatggaatcccaaagtgcactcaggcagacgtggagggattcaa

SEQ ID NO: 400962 - DNA, 461 bp, Homo sapiens
ttccatagtactatcaccccctaacagcctacatatttaacttatttatcttatatattgcctatgtcccccaactagaatatatgttctagttgaatgtcccccaactagagggctggattttttttgtttgttttgttttgttttagacagggtctcactttgtcacccaggctgaagtgtaggagtgtgatcttgactcactgcagcctcgaattcctagactcaagcgatcttcccagctacttgagaggctgaggcaggagaatggcatgaacccatgaggcggagattgcagtgagccgagatcatgctgttgcactccagcctgggtgacagagtgagactccatctccagaaaaaaaaaagccaaacaaaacaaaattatttgacaatagaaaggaatgaagtactactcatatgtgctacaacatggatggcccttgaaaacattatgtgaa

SEQ ID NO: 400963 - DNA, 589 bp, Homo sapiens
cacctccaacactggggatcacatttcaacaagagatttagagaggatgacatcccaactatatcagcaagcaaaagactagaaaaaggtagcaatctacattatgaacggttaatggccttaatatatgaagagttcttacaaatcaataagacaaacatccctttaagaaaaataggcaaagaacataaatggttcacaaaagacatattcctccatcagatgtgaaatagccacctcaatatactgctagtttttcaagttgggagtataataggtaacctcaaatttaaattatgtatttgtctataaatgcattgtttgcctccctctgagagaccacaagccccatgagggcagagctttatgtctgctgtgctcactgctttatccccagtgcctgaaacagtgcctgacacaggcatagcatgtgtacaataaacatatattaaatgaatgaatggtttaaaagtcagcaataataggctgggcacagtggctcacgcctgtaatcccagcactttgggaggccgaggcaggtggatcacctgaggtcaggagttcaccaacatggtgaaaccacatctct

SEQ ID NO: 400964 - DNA, 746 bp, Homo sapiens
tatataattttataatatggtattactgtaattttatagtaagttctaacttaaaacatgtaaacttaataaacaagagtaaagctgttcttgtgaacccatttaaattggttatagatttaataacctcaataccaaatttatttcaatattttatttaggataagcagtgccgagaggatactaattcacatagataaaaatgtaatggtctggattttacaattttacataaaagaacatttgcagtctgaatgcaaaaagaaaggaggtggggatgttggtgtagaaagaaactaggataagctgggtgtggtggctctcgcctgtaatcccagcactttgagaagctgaggctgggaggatcgcttgagcccgggagtttgagactggcctgggcaacatggggaaaccctgtctctactaaaaacacaaaaaattaaaaaaaaaaaaaaaaaaagaaaataggaaaaaagaaggaaacctgaatagaactaaactattcttactcttcttcatcagtgatattttgtagaattggcagaataagctctatttcagtatctccacaaaattatgttaatttggcaatccacatgtggactgccttcgatgtagtaaaagttgatatagaataaactgcattaatttttagccagtttaaaacgtgtgtgaatatcaaactggaatcagacatctgtggcactgtattatgtctctgtcaccctcaggttctatgaaacctt

SEQ ID NO: 400965 - DNA, 478 bp, Homo sapiens
atattctgtagattctccaggttatccaatatatgaaattttattgtaaaaccgggtctaatcttaataaccaaacagtaaatgtcgattttattagtctagttaaaaagcagtgatattaaatattcatccttatcatataactaatcattgaacaataattcattttttatataggcatttgaggaaaattacttctctttggggatagaagtgtatccacagtctccatttgtatgagggttggataaaagtaatttgaaataatttatttactgaaatatagcattatctctggtggtttcattctgttacttcataaagataatagactgtgagggaagatacatggatttctagcttgaaaattctaatgttaataatcacaaagtgtaactttgtttcagtatgttttcaacagggaaataagaggaaaaggaaagaaatgataaattcactagagaaattcaatcgtaaa

SEQ ID NO: 400966 - DNA, 799 bp, Homo sapiens
  misc_feature (10)..(10): n is a, c, g, or t
atgggtgaanggaatgtctttttctttgcttgggagaagaatctagaatccttgaagcagggattgggaaacttgattctgatgccacacataataaatgaaaaagctgtgaaaacattttgtgacttcttaaagaggccaattgcactgttaaaaatgctgtttaagatttatgggatttttattagtagtagttgaattcaggtattgccagcccacccccctcactttttcagacctatagttgtcctttttgattctccagttaaaactacaaaaaagatccatgcaacctttgcttatcctaaagtgacagatgttatagcctagtgctgtggcatatttctgccttggaaataaggagacttgggttctggttgatctggagccctaatcagtgatttattttttctctatgcctgcagtgtctataaaacgactgtggggagttgaacagaatgatttatgagtttctttaggtctgtcataactgctttattttgttgtactatcgcttcatgcatttacaccctgtcttagaggtggactaatgaagggacaagtgatttgcagttaggtgttcacctactttctgggtacatggaaatgaagagaggagagtgaaatttcttttttatttatgaattcatgtagaaatttaatattaaactgctttttgctttgtttttctttaggtatgaatattaaaaatgattatcaaaaagattggtgtcagattattttttggcctattaaatcaatattactatccactaaatttttaaatttgtcttcaaca

SEQ ID NO: 400967 - DNA, 431 bp, Homo sapiens
tctgctctctcttggaagctgccggggcgaggctcaggctgtggctggtccatcctatgctggaccaagttgtccctaaccctccagggctctctcacatctggggaaagatctgtgggcttctggacagcatttcatttggctacgtcttgtgcttgtggcactatgcggggcctctggggaacttcttttgctcaccatatttcctcatttcccgacctgtcccctgcacagccaggttccctttgaaatgccatctggagcagcaatggcccccagacaggccggctaagcagcagggcagccactccccagagcaagcctggtggccgagccggtgtgggcaaaacaagaagactctttctgcttctgaatgatctggccctgctgccatggggtcctttataaactctctcctgagttattctcta

SEQ ID NO: 400968 - DNA, 635 bp, Homo sapiens
gagaaagagagattttttacaaggaaaagtgtaaaggactgcttagctaatactaaaaaagcttcaatggtgccaaggaatacaaattaagaactcacatggagaaggccaataggatgtccttgtttattgaagagtaataaatatttttaaaaatagatttaattttgattaaagcaaagcctttcattgggtgcagcatttaatctataggaattctgttctataggactagttaagacagaatttgctcagcagaataaattcacctcttctgttatcaagttatataactactatggtgataagaatagttctctctgattttagaaatggtattagtaaacaatggcacatatcatgcatggaaggaagcacatattatgataataccatcctccatttgaattgtgtttttagattttcagtacactgaaataccttcaccagtttgaatctcccaagtctctggaaagtaggacagcaggcgttagtgtttttactttctagatgagacaggtgatcctgaactgaaacctgcttctcattagctcttagccttgtattagttcaactggaggaaacgtcaactcacttgtctttaagcctaaattccataacatttcaactggaag

SEQ ID NO: 400969 - DNA, 395 bp, Homo sapiens
ataccactttatttaaggaacttgagtatctgctcattttggtgtctgtggggtcctggaaccattccccctgcaaataccaagagacaccggtacttggttctttgatagtagcttcacactacttgaaattctacggcccttagaaaccctcacatctttaaaggggcttttacctcacagattggggtgaggtggaagtcaggagaaactactttctaaatcagtttcactttgagttattgtcctttgaatttcaatttctttggagttcttactttctaattatcacagacttgtgaaaacagatgatttaccttgtcaagtttatctttacatgctctaaagtttcattcatgatttattgtgaggatttaaaaatacaaaccattttt

SEQ ID NO: 400970 - DNA, 874 bp, Homo sapiens
caacctcctgggttcaaaccatcctcccacctcagcctttggtagtagctgggactataggtgcaagccaccatacctggctagttttttttttacattttttgtagagacagggtctccctatgttgcccaagctttgatccttcttgataggtgggaaagcaaaggtatctagaggcttggtgcaaatagtaacagatctgaaaaaaaagaacccaggctcctgggttcctggcctgtggttttgcccactaggctgactcgtgtttacagatgaatgtaagtttgattcttcctggccaactttggggttgatgacccctatttcaaggaagcccagatcctctgaggagcttcatttgtggcctctcaccagtgcctgagtctgcagggtcaggagatattggtgattattaactagtcttataggtctttaaaaaaagaaataaagatagggggaaggagtgggaaagtttagggggaaagtatatttttctcctaaggttcagaaaagtgggggaaaaatagatgagaataatcaggggaaaggaatatctctctagatttggaccgtggtgtgtttctcccatggattttgttatctttattcttgtgtagattccttctcataatcacagccccttcctgagggttccctctagcttttgttatcctggactattgagagttcttttaggggttactgatgagaaaaacccctaaaagaacttggggagaatcagctgcatctcactagttgtttgggagatctttatgtgtccagttgattttcaaaagatgaattaaacctttgagatcagttcaaaggctccagaaaagtactttaatagaatggcaaatctgtggagtagtt

SEQ ID NO: 400971 - DNA, 472 bp, Homo sapiens
cacgaggtttttcatcatcctaaactgaaactctgtacccactaaacagtaactccccactccccctgtccccagtccctggtaacagggggagtggggagttactgtttagtgggggaaaaatagatgagaataatcaggggaaaggaatatctctctagatttggaccgtggtgtgtttctcccatggattttgttatctttattcttgtgtagattccttctcataatcacagccccttcctgagggttccctctagcttttgttatcctggactattgagagttcttttaggggttactgatgagaaaaacccctaaaagaacttggggagaatcagctgcatctcactagttgtttgggagatctttatgtgtccagttgattttcaaaagatgaattaaacctttgagatcagttcaaaggctccagaaaagtactttaatagaatggcaaatctgtggagtagtt

SEQ ID NO: 400972 - DNA, 559 bp, Homo sapiens
aaaaaaaaaaactacctgatatttctaatcgcatcttcctttcttttcaggtttcagatttaagattttagcacttttttccaggccaaaaagggtcacatggttgctgctgtcttggctcctagaaacagtttccgtgatgaatcttttgttccaatgcttagtttcctatcagatggggttgtatctagtattagtaggttgtaagtttagagaattcagttgcttgatatattgctgcaaagtttagtcctcatgaccagttgaggatagagcatgtggtgcatggatgatctgagatgtgacttctgatttgttcctttttcatgtttgctgccgtggagaattggaataggctgttaattgatctgttcctttctagtctgatgctcctctgtgccccagagatggctgagtgatctttctgatgtatgtatttaggcatgccactcttgtctgcagttcttcagtgacaccaatttgcctttaggataaagaccaaacaccctgcagactgtgtgtcctgtgatgtcctggactttgcctagccatgcggccg

SEQ ID NO: 400973 - DNA, 365 bp, Homo sapiens
agctcctgcagggaggttgcatgatgcccacaaacccacctgtgaggcccataagcctggatgttctctcttagctgcttaggctctgcccctcaaaagcggaaatgttgagtgtggagtgcagcttgttctatgaatttgaagtacgtggtccctggggttggaccagcaacaagtgactcagtccctctgagactctgtttgctcctctgaaaaatgggtggtgttgtgggggacaattttctacctgatgagctcctcatgaggatctatgtaaagggtagtatctgattcattaccaggattttgtatgctttataggcatgccaaatacagctgtatcttactttattaaatcgaacgga

SEQ ID NO: 400974 - DNA, 702 bp, Homo sapiens
cagtttcaatttttatacaaatattaaatcactgattcttctatgatccaagcacagatatgttactttttaaggataaaaataatcaaatcacttaggttaaactggttgtctacagtcacacagtaagttagataaagcaaaggaggtgtcaaagggtaacactaaattccattcactagcatcttgcctcactaacactctcataagatagattactaaataatataagtattaataaatggaatttccaagaactttcaactaataaagggtgggattataagattagtttttgttttactaattacaactatatcctggaactatttacatactacctaggaaataaagtttgtttattcttgcaggattgtttttaaaagcagtattttcccaaatattaatttaacagtaatcctaaaagtaactcaggaaataaaaaacttatcacttcagtacattttattcataatgaggtaaagtttttgttttttctctatatatgtagatatatatagcaacacaggttaattgtgcttgaggattcctatgaattacaagattatacatgttcccattctatttttctactcctaaagcaatcgtatatacattatttcctaataactcaataaggtaaaagtcttaaataattttattttatcctctactcttctgagaccatgtattcccatgttg

SEQ ID NO: 400975 - DNA, 569 bp, Homo sapiens
tagaattaaaagcaacttgacttttgggttttgcttggaggtacatggtcaggctcaggagcaacaacatctcataaaaataaaaatactcccacattccagaggaatagtccatgtgtttcaagcagtatccagcaaagtgcagtgattctattgaatctagctatccctgtgtactttgtcattgggagattagacttctatgttgcctttgcaaccaggatattaaagtagaagatttcatgtctttcagaataggcttcaccagaattttctccaacctaaaggatgatcatgcctatgggatgatgcctatgggataattccactgtgaccagcacctatataccatagtggcaaaccctcacatttgtcgtatctgtttgtcatatttatcaatgatgacttttcattctaaaagccctccttccctccctgagagctagtaaaataattggatattggcaattaaggaaaacaaagcaaggaagggaaatagcgaatgtcagagaagtgctgaggagcagtctctggaccacttttcctgaggattcacaattaaaaaaaaa

SEQ ID NO: 400976 - DNA, 416 bp, Homo sapiens
tactaacaacagttctcttattccccttcccttcatttttcaggtttaattatctgccaggatctcctctttaggcacagagagaaatgaggtttttactttacttttcttttaatataagaaataatttggctaggcacggtgcctcatgcctgtaatcccaacactttgggaggtcaaggcaataggattgcttgagttcaggagttcaagactagcctgggcaacgtggcgaaaccctgtctctacaaaaaatacaaaaaaattagccggatgtcctggtgcacacctgtggtcccagcttttcaggaggctgaggtgggaggatcacctgagcccaggaggcagaggttgcagtgaacaaagatcatgccactgtactcaagccactctgggtgacagagtgagaccctgtc

SEQ ID NO: 400977 - DNA, 345 bp, Homo sapiens
acagttttgtaaacctctcctgagtgtctcccatagtcaggagctgtgaatacaaaggtaagtaagagtctgtgcctcatacagagagacaggcaaacatggagttttaacataatatggtgaggatacagtggcactgtgagtagaggctggtcacatggaaacacaaagaacagatgtttttcctactccagacattctcaaatattggtatgggtcagagtcactcaaagggatgaaaagagcagaatgctggacccacccccagagtgcctgactctgtaggtctggggttgggcccaagagtttgcattctgaacaaacctccagtgcacgctgctgctg

SEQ ID NO: 400978 - DNA, 468 bp, Homo sapiens
gcccacatgacctatttctattgtaactgccactggaacttttgaccagggtaaatcttgtgccttcttccagtgcctcctgctcccctcatcagtccccatctgtcctctaaccatgctgacttctgtccaaactgcttctggactggccctggcatagacctgcattagagatgcaaggcagcaaggtgtttatttatttagttagttaggaaaacagaacaaattctgggatgtaatgagaaatgacatacacataagaggcttatgaccaaaatacgttaatactcattgcaaaagaagttctactttttagctttacatttgaaggctttaaaaatatgtctgagagtgctatagagagttatactttcttcctccccatgtgacctaaacctccaattcagctgcttaaatagctgacaccgaccctaaaatggaaagctcatattacagaggagaaatatg

SEQ ID NO: 400979 - DNA, 442 bp, Homo sapiens
tgagacagggtgttgctctgtcacccaggctggagtgcagtggcaaaatctcggctcactgcaagctctgcctcctgggttcaagctattatcctacctcagcctcccaagcagctgggattacagatccacaccaccacacctggctaatttttgtatttttgtagagatggggtttcaccatgttggccaggctggtctcgaacgcctgacctcaagtaatccgcccacctcagcttcccaaagtgctgggattatacgtgtgagccactgtgcccagccaatttttttttcaatgttttaagacttgttttgtgacctaacatatggcctatccttgagaatgatccatgtgctgaggaaaagaatgtgtatcctgcagtcattgggcaaaatgttttgtaaatatctgttagatccattaggtgtatagtgcagatta

SEQ ID NO: 400980 - DNA, 442 bp, Homo sapiens
aaagaagcatgctgtgaacactgcaaagtaaactattagaaattaatggtcactacctataaagatagcaaaatactaaaggggtggtattttatgagcaatggaaacttttgttgtagatatttcaactgacactgtgcctttattactactttatacctacatctgaagatccagactctagtagttgtaatacaatagatgcaaacagtgggaacatctagttcttgtcaatgtgtcaccaaaacatattatcaaagctaatctcataagggtgtcagaggaaattaaagttcctttggctgcatgttataagaactgactgaaattttaaactacctcagtagctgactatatacagcagcaggaagccttcaattaactgcaccagttctatttgtagtacaaaggatctatggcttaggatagcctacataactta

SEQ ID NO: 400981 - DNA, 2697 bp, Homo sapiens
gaattccgggccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctagacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtctgcggacagggcagcgcccccagcccatgacaagggagtcttgttttctggcttggtttggggacctgcaaatgggaggcctgaggccctcttcaggctttggcagccacagatacttctgaacccttcacagagagcaggcaggggcttcggtgccgcgtgggcagtacgcaggtcccaccgacactcacctgggagcacggcgcctggctcttaccagcgtctggcctagaggaagcctttgagcgacctttgggcaggtttctgcttcttctgttttgccccatggtcaagtccctgttccccaggcaggtttcagctgattggcagcaggctccctgagtgatgagcttgaacctgtggtgtttctgggcagaagcttatcttttttgagagtgtccgaagatgaaggcatggcgatgcccgtcctctggcttgggttaattcttcggtgacactggcattgctgggtggtgatgcccgtcctctggcttgggttaattcttcggtgacactggcgttgctgggtggcaatgcccgtcctctggcttgggttaattcttcggtgacactggcgttgctgggtggcgatgcccgtcctctggcttgggttaattcttggatgacgtcggcgttgctgggagaatgtgccgttcctgccctgcctccacccacctcgggagcagaagcccggcctggacacccctcggcctggacacccctcgaaggagagggcgcttccttgagtaggtgggctccccttgcccttccctccctatcactccatactggggtgggctggaggaggccacaggccagctattgtaaaagctttttattttagtaaaatatacagaagttctttttctgaactca

SEQ ID NO: 400982 - DNA, 1527 bp, Homo sapiens
ctggtcgatgggaaagggcatctacgtctcacccaccttcaggaggtcctggaaggtgggtgagacgtagaagtcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtctgcggacagggcagcgcccccagcccatgacaagggagtcttgttttctggcttggtttggggacctgcaaatgggaggcctgaggccctcttcaggctttggcagccacagatacttctgaacccttcacagagagcaggcaggggcttcggtgccgcgtgggcagtacgcaggtcccaccgacactcacctgggagcacggcgcctggctcttaccagcgtctggcctagaggaagcctttgagcgacctttgggcaggtttctgcttcttctgttttgccccatggtcaagtccctgttccccaggcaggtttcagctgattggcagcaggctccctgagtgatgagcttgaacctgtggtgtttctgggcagaagcttatcttttttgagagtgtccgaagatgaaggcatggcgatgcccgtcctctggcttgggttaattcttcggtgacactggcattgctgggtggtgatgcccgtcctctggcttgggttaattcttcggtgacactggcgttgctgggtggcaatgcccgtcctctggcttgggttaattcttcggtgacactggcgttgctgggtggcgatgcccgtcctctggcttgggttaattcttggatgacgtcggcgttgctgggagaatgtgccgttcctgccctgcctccacccacctcgggagcagaagcccggcctggacacccctcggcctggacacccctcgaaggagagggcgcttccttgagtaggtgggctccccttgcccttccctccctatcactccatactggggtgggctggaggaggccacaggccagctattgtaaaagctttttattttagtaaaatatacagaagttctttttctgaactca

SEQ ID NO: 400983 - DNA, 938 bp, Homo sapiens
tgtgacctcttcaactttgccctcacttccgctcatttccagtgatccactcccattggcacaagtttggcctacttactataaatcagaattattctatccttgaaatcttaaactttaatattctactttatgacttcaatttagttttccagctcaccacctttctttcttccaacatctcaaccaccgtagaaagaccccataataggccctctatcttccagttaataatgtttctcttaactgcattttctcattttcatttctatctagatgatagttactccatagtccattactttatgcattggtggatgtgggccactggctctttgctgttgtatagaatctgtcctgtgaacagaagcattgtagatactccagcagcacagttaactgttgcctactgctgcatacaatcccccagccatgaggactggaaccacaatgaagagaagatcccagccccaccagaagtcatctctccctccaaattccctcaatagccatttcaaaccttcactgccattctcaaatttccccaattcttgcagttgtctcttgtcacctatattattaggaattgaggctattaagacagaaaggcctagttacccatccttgccaactattgacttatctccagttgtacccaagattttctcctgactctgtggaagccagcctctcttacctgcactgaatatcactaccaggtcccatcaacactagccttctcaaggtctttaatctctattttttgatctgtaaattataaacattaataataataaaattaggagtaatcattttctctaaagaagcaggtttcttagcagaaatccaagacaggaagaattcctagcaggttattaggtctacaacataaagaggcctcctgggcagatggccaaaccagcaatgttgaaagagct

SEQ ID NO: 400984 - DNA, 415 bp, Homo sapiens
ctgtcacccaggctggggtgcaggggtgagatcatagctcactgtagcttccaactcctgggctcaagaaatcctcctgcctcagcctgctgagtagctggtactacagactcatgccactgtgcctggctaatattttaaaaaaactgttggcagagacagggtctcactatgtagcccaggatggtcttgaactcctggccttaagggatcctccctccttggactatcaaattgttgggattataggcatgagcacactgcaactgaccagagctgacttttgaagtcaggactcagtcctagtacagtctttgcaaatcttactgtttagatgatgtcttaaactcatttttctagaagtgctactaaaatacatattacttgtggcaaaatgttggatactaacaatatt

SEQ ID NO: 400985 - DNA, 792 bp, Homo sapiens
gcggccgcctcgcccccgcccctgccccccgcccgagcagctgtcagcggcgcgcgcggccagctcggccccagcgcgcgctgtcaacagtcattagcgcggcccactcccctccccctccagccccacctcttcccccggccctgggtggggcccgcacctggggctctccgctcgttagcgcgcccagggcgcctcctcggcccgagagggacccgcccgcggggcctggctggctcagggctacctccttccgcctaggacccccccttcggtgactcccgattccctgtcctaggctgcggtgccccgggaggcgggtcgccagagtagcagacagagctctttaatgggtgtcttctagggcgggtgctgtttgtgcatcatttgggttcccacacacttcctatgaggtggcgaaagccattatgcctatggtgtctgctcacacagggggaaactgaggcccaggcaggacagccccttgcctggggtgggggctgggttgtccttaggcctgtgacttcacctctacagcaccctcctgtggaccctctccctgcccccgccaggccagagtcctgcagccaggcccagaccctggcctgtccgtccggggatgctggacagtactcctccctccagccctcataagtcattgtcattcggatctgcatttccccagcccctctccttctaactggggggcactgtggcccactgtgcccctttctcttcccattccttccccctacacccattccagacatcccagagttaacaaaacccaaa

SEQ ID NO: 400986 - DNA, 380 bp, Homo sapiens
gggcaaaaaatttctttctgccacctatcatctcaccatttctaatacactcaccatgtacactctgccttttgacatctgggtataatcctcacccagtttgggaagtctgtcttcaaggaattgtggaagacaagcactgcttcagcataggaaggcgggattccagtcttgactattgctgattttatcctgatatttcgctctggtaaatgactttcccttgagtaacttggaatgggattgcgtttgaaaccataatgattaagtttgaattgtagagtggccttcctgaatgcttgtggaattcctctgagaagaaactctacggtcacttttttgcacgtccttgagaaaaataaaatatctaactgcttctg

SEQ ID NO: 400987 - DNA, 359 bp, Homo sapiens
ccgggcaccgacctgggtcaccaccatcagaattgacgcacagaacacgcctgtcacccagaaagctcccctgggctctccgctccgtgcccttgccgtgttcccggccccaggcaacggatgacctgcttcctgtcactgggcatgcgtttgcattttccagaattcctaggaatggaatcagacagcgtgtgctcctgatgggctggcttctctcactcagcataattaaacgtggcttcctccacgtgccgcgcatcaggagctcattcctgtttcctgctgagtcgtgttccgtggtggggaaggccaccgtttgtttacccactcacctggtgatgaacgtttgggtggttccc

SEQ ID NO: 400988 - DNA, 660 bp, Homo sapiens
agttactttgaatcctgccaatttcaccagattagtcaacctaaaaggaagaagctgaggccaacataatgtaagtagagtttatttgggccaagcttgaggactccaacctgggagcatagattcaagttgccctctgattagcaacagatacgagttgatttttaaaggaaaagaagaggcagttcctaaattctttaccaagaatttacatttaaataacataagctattgattggctatccattgttctttgtccagggacatgaagataatggatgaggcagctaatcaggaacaaaatgactttaagcaattgccctcagacatggatgcatgtggtgaggtgtgactgaagtcccatactcgtgtctctctggacctgcatatctcacacagctcagacttctgtcagctgtttttcttttctcagaagaaatgacgtacagatttattaatgtgcacaaggagaaccacagagtgattactcccaccctttcatggggttcagaagcttgtgtaccatcttgaggttacagaaggaatgccaccttggattgtggcacagccctcagaaagaatagaaggtagatgtttctttcagacttttaaggtgtcagactttctaatcttgcccagatccagataggggagggcttc

SEQ ID NO: 400989 - DNA, 236 bp, Homo sapiens
agccctgaaggcatctaggctggcagaaaattacattagtaatgagaagtttattaacaatataattgggttaatctcatcatttttagtcaggattctttgggttgcaagtgacagtgacccaccccacaccgttggttcacaaaataaaggaaaggagggccagcagagcccaggatggggagggctgtggccggtctgcaggacaactgggctcagcgacctgggtatcacca

SEQ ID NO: 400990 - DNA, 491 bp, Homo sapiens
agctcctacgtattcagaccctcagcctcgtgggggaggggagaagttggaaggtgcaaccccctgcccagaccctctaggctgtgaaaagcctttcccgcactgttcaaccaaaacttcttttctgatcctcttgggttatgaacgtctgtgcatctgagggtggtcctgatttcattacttgctcgtgttttggatgagaaagctgaggcccagtgaaagccaagttcaaacccaactttagcagaccctgtgctgtgctggtaaactgcctccagcaaagtaaaaagccccggtttgtagcatttgctaattactgtggtgtaaatactcccaccatggctgatttccaactacccacatttaacaaccagctattaacaatattcctggccgggcatggtggcacatgcctgtaatcccagctactcgggaggctgaggcaggagaattgcttgaacccgggaggcagaaattgtggtgagccaaga

SEQ ID NO: 400991 - DNA, 341 bp, Homo sapiens
tctcactctgtcactcaggctggaatgcagtggtgtgatcatagctcactcagcctcaaactcctgggctcaagcaattctcccacttcagcctccaaagtagctgggaccacaggagggcactgtattgccaggtccctggatgtggtgtgaagactgttctctacaaaactctagaaggcacgattttcatcagattcacagccagcgtggccatacgcagtaagcctgtattaggtagccatgtttattgccccaaatactaccgagccataggcaataacctggctttcttttctgtaaaaattatgttagtaaaacttgactaccttatttagaag

SEQ ID NO: 400992 - DNA, 380 bp, Homo sapiens
gtataaagcagagaagtgctccttggggcaaaaggcaattggcaaaaagctaaggaacattttcataatgagttagaaatacagatcatcaggaatatccaggaagcgatagtgaataccaggcaggcttaagagacaggaaacatttagcatgttggtaaaccactttagcacatcagcaaaagcatataaacagctttaggattggaaattattgccatggggaaaggcaacaatttagaggagcaattccaattaaaaatataaagatcgtttctttagattaattcttgagttgctcccctatgcctgtgtagcagaatctaaaagataatcatgtgaacgggagattatattttaaaaataaactttgaaattca

SEQ ID NO: 400993 - DNA, 283 bp, Homo sapiens
gggctccagcaatcctcccaccacagcctgcagaacagctgagactacagatgcatgccaccacacctggctaattacaaattttttcttttcttttctttctttttcatagagacagagtctcactctgttgcccaggctagtcttgaactcctgggctcaagttgtctgcctgcgtcaacctcccaaaatgctgggattataggcatgagccaccacacccagccctgatctgtttatttagaagtggtagtctaaccactggcaaaaacaaaacaatacg

SEQ ID NO: 400994 - DNA, 511 bp, Homo sapiens
taaaggataaataattcccttatgtagatgtatgatattttacttattcatctgtgaatggacaacacttgggttgcatctaccttttggctctcgtgaataatgttgatatgagcatgggtgtacaaatatctagtctctactttcagttcttttgggtatacacccagaagaagaactgctggatcatatagtaattctatgcttgatttttttgaggagctgccatactgttttccacaatgactacaccattaaagggatattttaaatgaacgaacaaaaaaacccagcaggaaaaccctctattcttacagtctttggaattttacaatgaactttctaaaataggatgaagatagcttcattggatttcttgtgtaactaataattctaggaagtgtggtctctgtccttagaggtaagtggtgggcagatttaaaattaatatatcggtttctctttggataattacggagtttggagacattaggggaataacaaaggtgag

SEQ ID NO: 400995 - DNA, 669 bp, Homo sapiens
gccggttttcctatgtgctctagcaagatagcactgagcttaatgcctcacaattgctgtgttctccctcctgcagtgcccagagatgctctccacaccatgatgctgctgctaggtgtggggaggtgtggtgatggcaattcaagactgtttttttaatttctttggtgcctctttaagcaatataaagtttaaactaggtactataagtgctcagttgatttttggttttaatggtgtttttttctggttagatagttgttaaattggtgtccttgctgggggaacaatggatggaaccctttattctgccatcttgcttcacctctctattgttaataatttaataatggtaaattggaattttttttaacttctctggactttatagttttctcatttttaaaataaaaagctgaaataaaacactattgcaactgtaaattatttcaaggaatatttatttgctatttcattttttaaatatatatgttattttcagagcagttttatgttcacagcaaacttgattggaaaatacagtgttcccatatacacctttcccccatgtaggcatacgctccctactatcacaatctcctgacagagaggtatatttgttgcaattgatgaacctatactggcacatcattctcaaccaaagtttat

SEQ ID NO: 400996 - DNA, 428 bp, Homo sapiens
caaaattcagctatctgtatgttaggtaaggaaatggctgttttcactttccacctttcagtatttcaaggtttccatgttgtacattaatgcataacttaatgacagggatatgttccaagaactgccttagtaaagcagtttggtccttgtgccagcatgctagagtgtacttacacaaagctacgtgagagagtctactactcacctaggctgtatggtatagcctgttgctcttaggttacaaacctgtacagcatgttactgtactgaatactgtaggcagttgtaacacaatggtaagtatttgtgtatccaaacatatctaaacatagaaaaggcacagtgagaatatggtatcacagtcttatgaccacctttgttcacgtggtctgtcattgactaaaatgttgttagtgcatgacctt

SEQ ID NO: 400997 - DNA, 440 bp, Homo sapiens
cttaggataatggcctccagctccatccatgttgctgcaaaggacatggtttcattcatttttatgccagccagcccttcttgcattcacaatcatcttcctaaaagaaaggttcctttaaaaaaaaaaaaaatcacccttccatgtataaaccacatgctcaaaacgacacatccgtgtctctcttatgctgttttcctggcctgtaatgtccttttcccaatggaatgtcccgagtccacagcagcgttatggagaggcgatggattccacacttgagacccgggctcccttcctcaccagctacatgaccttggttaactcatttgacctttcctcacttctaaagtaggggctatatactaaccattgccgacctcaagcactatagaaaggcactaaatgggttaatgcatgtaaaacccttgtcaaattcaaag

SEQ ID NO: 400998 - DNA, 2523 bp, Homo sapiens
aggacagcccaagaactggtctagcctggcagccttttccctcgggtagtagaggctgcccctctgacagggagtttgtggtcagcgagtgggcccttgggggtcttgggctgtcacagggactccagaaagccatgcagagccttgtgccatgaaggacttctcagatgtcatcctctgcatggaggcaacagaatcgagcaagaccgagttctgcaatcctgccttcgagcctgagtctgggccaccctgccctcccccagttttcccagaggatgccagctacagcgtcccagctccctggcatggtcggcgtcctcgagggctacggccagactgccgcttctcctggctctgtgtcctcctgctctccagcctgctcctcctgctgcttgggctgctggtggccatcatcctggcccagctgcaggctgcacccccatctggggcgtcccatagcccactgcctgccggaggccttaccacgaccaccaccacccccaccatcaccacctctcaggcagctgggacccctaaagggcagcaggagtcaggcgtgagcccctccccacagtccacctgtggaggcctcctctctggcccaaggggcttcttcagcagccctaactacccagacccttacccccccaacacccactgcgtgtggcatatccaggtggccacagaccatgcaatacagctcaagatcgaagccctcagcatagagagtgtggcctcttgcctttttgatcgcttggaactctcccctgagcctgaaggccccctcctcagggtttgtggaagggtgcctccccccacgctcaacaccaatgccagccacctcctggtggtcttcgtctctgacagcagtgtggaaggatttggtttccatgcctggtaccaggctatggcccctgggcgcgggagctgtgcccatgatgagttccgctgtgaccagctcatctgcctgctacctgactcagtgtgtgatggttttgccaactgtgctgacggcagtgatgagaccaattgcagtgccaagttctcggggtgtggggggaatctgactggcctccagggcactttctctactcccagctacctgcagcagtaccctcaccaactgctctgcacctggcatatctcggtgcctgccggacacagcatagaactacagttccacaacttcagcctggaggctcaggacgagtgcaagtttgactacgtggaggtgtatgagaccagcagctcaggggccttcagcctcctgggcaggttctgtggagcagagccacccccccacctcgtctcctcgcaccatgagctggctgtgctgtttaggacagatcatggcatcagcagtggaggcttctcagccacctacctggccttcaatgccacggagaacccctgtgggcccagtgagctctcctgccaggcaggagggtgtaagggtgtgcagtggatgtgtgacatgtggagagactgcaccgatggcagcgatgacaactgcagcggccccttgttcccacccccagagctggcctgtgagcctgtccaggtggagatgtgcctcggtctgagctacaacaccacagccttccctaacatctgggtgggcatgatcacccaggaggaggtggtagaggtcctcagcggttacaagagcctgacaagcctgccctgctaccagcatttccggaggctcctgtgtgggctgcttgtgccccgttgcaccccactaggcagtgttctgcccccttgccgctctgtctgccaggaagcggagcaccagtgccagtctggcctggcactactgggcaccccctggcccttcaactgcaacaggctgccagaggcagctgacctggaagcttgtgcccagccctgaccctgaagccggcccctgccctcttcctgcccgtcctcttttgccggtcagggctggcacgcaggggaacaaaggaaggagcatcagcagggtctctacccatccttctctggggctcccagggagggggaagagaagtcctcagctggggctcatgggaccctaccaccctccctgctccttcctgtccctttaccggtcccaggctgctgactggccccacactgtgccaccggacaatcgagaccacttcccatccaggcctcttcccctttccatctgctttttcagcttctccatcgcctgccttctgaccttttccttgattcaacaaaaatgtactgagcatctattcatgtggcaggcccctgtcctaggccctagggatccaactggctgtctgcctctagaactctccaccctcatctctctgcgtatttctccctgaaatggggtctggtccttggtctctgccactgccctgcctctcctctggccctgggaacaggaggtgccctgtgtgtccgtctctcgaagttctgcctctctgtgcccagctcaagtctctctccccctcctttctccccctaaactttggccggccgccgggcgacaccacgagttatttccca

SEQ ID NO: 400999 - DNA, 1532 bp, Homo sapiens
  misc_feature (405)..(405): n is a, c, g, or t
gccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccntggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaaaattgttaccagctcatgctttacaagaaaatgccttggcattatgccaaagagaagtcgatggaggtgacgatggacgccgaatgttggggagatgctgccttccacgtgacccacagtccccgcagcacggctgcatggggctggtgcaagtcagcacagccgtgttccgatcgttcacacggcgtttgcatttctcatggctggctggtaaatcagatccaaggaagagcagcctgtcttgaagtggatttgtgaacggcacaaggccccggtgttaagatgcccgacagacaaccttccatccttcttttcaagacagaaacaatgccaaagtgttatccgagttacttgcttttattaaaagttatgctttttt

SEQ ID NO: 401000 - DNA, 1734 bp, Homo sapiens
  misc_feature (405)..(405): n is a, c, g, or t
gccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccntggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaaaattgttaccagctcatgctttacaagaaaatgccttggcattatgccaaagagaagtcgatggaggtgacgatggacgccgaatgttggggagatgctgccttccacgtgacccacagtccccgcagcacggctgcatggggctggtgcaagtcagcacagccgtgttccgatcgttcacacggcgtttgcatttctcatggttagggtacatttaacagagtaacttcacaattttgatatctaaaaatcactcattttctgcagcatcttccacccttgttagtatatgcctcaacttggccaaattgtcttaattataaaagggatttataatctttagcacaaagataaaacacagaaaaactgcattgcctaagttgacgccaaattaaattgccagctctggttttgtgcatgctgacaggggcagcgtagggctggggtgccttccttccaggatgagagcaggtgatgagacctgcatgtcactcaatcaagctgtgttttctacaccatgtgtttcctcaaaagaacacctttgaggaggaggagagaggaaaaaatttaggagagagaaa

SEQ ID NO: 401001 - DNA, 776 bp, Homo sapiens
caagtgaatagtggttttataaatatcgtccacgtcaatgggattttaggccaattagcgaatcgggccagtgtttccccgcacacccattcacgtaagatggttttcatgaacatactggaatcccagagtctgcagaaaaccctgcagtgttgaatagggatgtccagcgatggtgtccaaaaccctcgcgatgctcggagatgacacagggctttgggaagcgcaggaatcgggcgacaatgtcagactagcgcagtgactgcagagacgcaaggtgcgaatctgcagaatttctttcctgatttgtccacgctgcccctgacgcctctgccccctttggagagtgcgagggagcttccacaaatcccatcctgtgcagaaggcaggcctgtggcctgggagccggggaccagggcagacgggggacgggagtgaaggatgcggccctgggggctgcggtcgggaagggtcaggccaggccccagggccgctgagctcgcgagctgctgggaccctcctccgagcacctgccaacggtgacttgcgctgcttttcaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctc

SEQ ID NO: 401002 - DNA, 1740 bp, Homo sapiens
  misc_feature (405)..(405): n is a, c, g, or t
  misc_feature (1179)..(1179): n is a, c, g, or t
gccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccntggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgtngggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctcccc

SEQ ID NO: 401003 - DNA, 1290 bp, Homo sapiens
  misc_feature (405)..(405): n is a, c, g, or t
gccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccntggccccaggacagccgcggcctctacaactccacggacagcctggacagcaacaaggccatgaacctcgcgctggaaacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagccgcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaagtaagagctcaggcttccctagggcctcttaaatatcatttctcagtaatgcaaatatgcacatcacagcattagtggagaaaagttcctccctttggtattcaagtgaagggaaataaatgtgctttctagtatat

SEQ ID NO: 401004 - DNA, 472 bp, Homo sapiens
cgtggaggatggtccagggtgtggctgccagagggcatcgggggccaggcaactccagaaaggagctaggaatgttagagaaaactgcactaacagccagcatgcgtgaagaactgattcatactacaccgtggatgaacctcaagaacattattctcggcaaaagcagacagacacaaaaggtcacatagcaaatgcttccgttgatatgaaatgtccagcactggcaaatccacagagacagaaagtagatgagtaatagccagcggctgcagacagggaaggaggggagtgatgacttaatgggtacagggattttattttggggtaatgaagatattttggaatgagacagagctggtggctgcatagagcactatgaaagtgctaattgccattgaattattcacttcaaaacagttaatttaacgctatgtgaatttcacctcaataaaaaaggtacaaaataaaa

SEQ ID NO: 401005 - DNA, 397 bp, Homo sapiens
gtatttccgaggttacgtgcggtcttctcttctcccccatccctcttccctgcctccctcctgccggccttgaggcccctgaggagcagtggagaggccaggtgtcttctctgcccagcgctttctgtgacttctttgagtggctacaggttgagggttgactgtgcgggcgattgcagcgtggccctttcacctctttgcacactgccacatgctgccacaggatggcagtgcaggtctggctctgtttctctgtttggtgccctctatcgatcgtcgtgaggcttgggatgggcctagattgtgagcagctgccagaaagcccagatttgacccaagctatttatatgttataaagttataataaagtgtttcttcctgtttgtcccccctggta

SEQ ID NO: 401006 - DNA, 450 bp, Homo sapiens
gtatttccgaggttacgtgcggtcttctcttctcccccatccctcttccctgcctccctcctgccggccttgaggcccctgaggagcagtggagaggccaggtgtcttctctgcccagcgctttctgtgacttctttgagtggctacaggttgagggttgactgtgcgggcgattgcagcgtggccctttcacctctttgcacactgccacatgctgccacaggatggcagtgcaggtctggctctgtttctctgtttggtgccctctatcgatcgtcgtgaggcttgggatgggcctagattgtgagcagcatgggtgccaaggccagggcaggagctggcatggggcctgtgtgggccattgtggtaggaagcctggcagtcgactggcccagaggatcccaggctgctttccttcttgaggctggtggcaggagggctgctgacgga

SEQ ID NO: 401007 - DNA, 356 bp, Homo sapiens
tctatctacaagcctaggtcccttagtttcttggaacttccatttcttcaactgtaatataaggaaaataatagtactgttaccggaatggggtcctgatcaagactccagagatggttcttggatctcacacaagaaagaattcaaggcaaattcatacggcaaagtgaaaatctcttgccactcagctactaacccagtttttctctccaccgccacctgctcagcttttaatgtatgaaacttctagggaagtttcagatgggagaaataaaggagttaaaaacatgctgcctcaaaatatgctcctctggcatattgactattatgaaataaaggtacttgaaaaacagcag

SEQ ID NO: 401008 - DNA, 205 bp, Homo sapiens
taccatagctatatacatggtatatgtgtatagctaaactcaagtgatttagtctttagaattaggaaaatctattcattagccacagagtcaaaatgaagatgaacatgaagccctttttatgatctcatgaagcagagaaaatttcattataccatggtggtgctatttctcaagcaaactattaaaccaggattttatggta

SEQ ID NO: 401009 - DNA, 613 bp, Homo sapiens
  misc_feature (613)..(613): n is a, c, g, or t
ccatatgcagggatcttgtcttgtgttttggtgaatgttgcaactcttgtgctgaatccaagggccaaaaaacatgaagtataggtaataggccctaagggtatgacttgagatcaatcctgtctcttccattcacaaactgatttccttgtgaaattcatttagcctcactgggcctcagtttttgcatctctgaaatggtcaaggtaggatggttgtatttgagcgttcagtaatatgcttataaagtgtcagcacagtacccagtgtgtggtcagggttcagtaactggtaggtgcccctgctactgtaatccctactgtggaagagcaagtgactgggaggcaggaatttacgtcccaatggtggggcgctcagaggattgcagagcaggaaggaagaacttggggcaggtgtaactgaggagggactgtgaagggtaagtgctcaggcctctcctccccttcctggagtgctcaggggtacagagttttgtaagcacatggcactttcaggatgaatgagaggctcaccgtctcgtgccgttcggcacgaggttttttttttttttttttctctttagctattgcctgacttctatttctttgtcttn

SEQ ID NO: 401010 - DNA, 459 bp, Homo sapiens
tgcactccagcctgggtggtagagtgagagcctgtctcaaaaaagaaagaaagggaatcagtactcagagcacttaacagtcctttgcagacaggcacacattagggagaaacgggagtccctgtgctggctccccacagaggtgggacaaggcgatgctctgccctcctcttcacctcctacccagatgcccggagaggagacaggagggccaggcagtgtcacgtgtcacgcatgaggccagttctagggttagttccaggggctccaagcccagctgtggcacctgttagtggggtggctagtcaccctatatttccaacttcctttaaaataaaggaaatagaactgaccaggatgcattgctttgaggatttcctgttagtagggtggccagccaccctatatttccaacctccttttcgtttttgtaaaataaaggaagtagaactgaccgga

SEQ ID NO: 401011 - DNA, 448 bp, Homo sapiens
cgagaggagagagaaggaaattaaaagacttaaaggatatgtcaatcattttcagtatgcagttcttatttgaatttgactcacacaaacagtttaaacaatatgataacatctctgtggcaattggagatgttaatgctggctggatatttgatgaaattctagaacatgtaaaacttacttatagcaatggcatatcagtgacacttggggacagggatggagtaagccggggaagactgactgcaaagaaacacaagggaactttttgggtaatgaacatattctatgtcttgattgaagtaatagtatatatacttgtcaaaattcattgaattgtacacttaaaaattgatatttttatgcatattcttcctaaataaaatttatataaaatgtgcaaaacaaaacacaaaataaacgataatgacaaaactaaaaaaaaaaa

SEQ ID NO: 401012 - DNA, 696 bp, Homo sapiens
cagtggcatgatcttggctccctgcaacctctgcctaccagattcaagcaattctccctgcctcagcctcacgagtggctgggattacaggcacccaccaccatgcccagctaattttttgtatttttagtagagacaaggtttcaccatgttggccaggctggtctcgaactcctgacctcaggtgatccacctgccttagcctcccaaagtgctggattacaggcgtgagccaccgtgcccggccatatatactatttttttaaaaaagagagaagtcattttagcttactctaaaaggaatggtttgcctaaaacctttactgagataaagacattccaggcagaggtcacagcacatgcaaacgtctaaagatcatggcatgcccaggtaactacaattcaccattaaattttgagtcgatgtaaaggtaaactataaactaaagaataagttgagaatctctctgattcacaaagcgagtaaaaaagacaagtaagattccacttggccaggtgcggtggctcaagcctgtaatcccagcatttttgggaggccgaggcaagcagatcatgaggtcaggaattcaagaccagcctggccaacatggcaaaaccccatcttttacttgccattacgcaggtttgcccgggcttgccaggcatccccaggccctagtcattctttacacacgt

SEQ ID NO: 401013 - DNA, 425 bp, Homo sapiens
tcaaattttatcttaactttatagactcaatgtggcacatttattacttaatcagagataggagagagagaagaaaggtttcctaaagctaagaaccctggaatccatgagccctcttaaatagcatctttaattttattttgtattgtggccatttttcagaagcattgagggtaggaaatgatctattaagctatttcacttttatagctaattctacactatcaaatgcttgccagattctcccctttatttgagtatatggcaaattacataggtattgaaccattttgattacaagggtagggtgtcaatttggtctgtaaacattgttgttcgcacttttatttattttacatttaaaaatctggcttgtcagtgcatcctccccaactaaatttgtttgtgtcataaattattaggaa

SEQ ID NO: 401014 - DNA, 544 bp, Homo sapiens
cgaggcgagtgaatcacttgaggtcaagagttcaagaccagcctggccaacatggtgaaacactgtctctgcaattaatacaaaaattagccagacatggtggtgggcacctgtaatcccagctacttaggaggctgaggcaggagaatagcttgaacccaggagatggaggttgtggtgagccgagatcataccactgcactccagcctgggggacagggtgagactctgtctcaaaaaacaaaacaaaacaaaaaaagaacaagcaagcaaaaacagccctggccagtccagctcccttcctggagggatgtttcacattttctccagatcatggcataaagtagaagtcagtatgaggtaaaaagatggagagccaagagggctttctaatgcctctcagcaagccgctccaccctgcccaggtgagagggcccaggttaagagataagctatggtgcaaggagtcttggcccagggctccttctggacttctttgcactcactcctatggctgccctggcaggacatggcagcccaaaag

SEQ ID NO: 401015 - DNA, 391 bp, Homo sapiens
tactatgacgaattttgacctgttttctttgttacttgttgaatattgtcagacagagaacccaaagaagctatgtatagataccagcactctggtagaaatacacgaatgtaatttttttttctccaagtatttggtttattctactacttctggatttggtttttcaaaatattgattattatcctcaggaacatttttaatgtgagttatcaacaggatagctttttgtaagtggctaagttgtagaatctcattttggagccatctctgccaatccagcttgttgcatgtgaaggcaagctgtgggtcagagcacagaaatgtttacagaggctttcctaagcctggaggcctggagagatttgaaggaacaaatagagcatactta

SEQ ID NO: 401016 - DNA, 837 bp, Homo sapiens
ggtgttacaaagcataatatgcctccaagccaggctgcccaaaaggtcaaatccagaaaccagtctaatagactgaggaaagcaagtgaaggtaacttgacacgccataaagaactgttcaagtgagtggactcattgtgagatgcctgatgcactccagagaaatcagatttaggtccaatagcataatacaagaagtcaagcacgtgagggcctcctgtgagatctcgatggggcagccaggcacggtgactcacgcctgtaatctcagcattctgggaggccaaggctggaggatcatttgagcccaggagttcaagattagcctgggcaatatggtgaaaccccatttctacaaaaaaatacaaaaaaaattagctgggtatggtggtggtgtgtgcctgtagtaccagctactggtgggagctgaggtaggaggatcacctgagcctggaaggttgaggctgtagtgagccatgatcacaccactgcactccatcctgggtgactgagtgagactctgtctaataacagcaacaaaatctcaatgggacccagcatggtggctcatgcctgtaatcgcagtgctttagctgactgggatggaagatcttgcctgaggccaggagtgtgagaacagcctgggctacatggactttaccaaacactctttttaaaaattagtcaggtgtagtggcgcatgcctgtagtcctagctactcagtaggctgaggcgggaggatcgtttgagcccaggaagttgaggctgcagtgagctaggatggcgccactgcactccggcctggacaacagagctagtgagactctgtctcttaa

SEQ ID NO: 401017 - DNA, 218 bp, Homo sapiens
tgctcaggacatatttattgactgaatgaatggtgtttcactcaggcttttgatgtgggagaacccaggggatgctctagacagagggaacagcatggcaaaggcctggaggtgggatggcaagtcctgacaggtcccttatggttggagctcaggaggcaagggtgggggagttgaagcagggtggggtgcctgggggcatggaggacattggatct

SEQ ID NO: 401018 - DNA, 670 bp, Homo sapiens
ggtaacccggaaaagtcctctgagcctgataggaattcagatctgccttgtgtgaacagaacctcccgcacgcaagttctgagctgagaaattatttaaatagcatcaaaatcaatttccatgccattaaatattctggtctgtgttttaattgagacgattacatattccccaaaaagagaagagctatttgaagaatcgtgtcttttctctcttcctctcactggaactgacaaggaaagcacctcagagagctgcaaaccgcctgttagcctgccttcgttcctatccatcttctttagagctaacctggtttattatttttctttaagaaataaaaatggagctctaagaggcacccagggcactgggaactctgagttcttcaaatagaataaaccaggtcattctctcttcttcttcttaagggcttgggtttgtggtcggtggcaagaggcagacatgcctttgatgtcctaggagcagatagggaggtgaggatcattcccaacctctgctgctcccaggccttcttcctattcagtaaatattttgggtgcatcttccatggtccaagaactcactgtggctccctggaggagctcccagtctgatggggggatgttcctgaaaacaagtcattataatgcaacatacaaggctctccacc

SEQ ID NO: 401019 - DNA, 1240 bp, Homo sapiens
cccaagaagcaatgtaaagtttgaaacgagccgagcgcggtggctcacgcctgtaatcccagcactttgggaggccgaggctggcgaatcatttgagtagagacggggtttcaccgtgttagccgggatccatctcctgacttcgtgatccgcccgcttcggcctcccaaagtgctgagattacagacgtgagccaccgcgccctgcctatattaggtttttaaatagcaggaggcaaagcttttcggtgtgatcctgacttcacttggggaaaaagggcagacacagggtctcactgtgttggccaggctggagtgcggcagtctggaactcctgggcccaagtgatcctccaatcagcctcacaaagcactggaattacaggtagctcagagagctgcgctggaggagaaaagccagtcctggcaggagctctggtacctgggaagctggatggagagcctgggccagaatcccggacccctcacctctgcggcctagctttgtgaccttggcaaatccattctatgcacctccatttcctgtacagtggggatccttatttctctggcacagattggtatttgttctgtaaagcccagtaccactttattttattttagttattgatttttttgagacagggcctcactctgttgccaaggctggaatgcagtggcgagatcatagctcactgcagcctcaaactcctgggctcaggccatcctcctgcctcggcctcctgagtagctgggacgacaggcgtgcaccactgcgcctagctccagtaccatgtttaaacggtgctcagaaaacgtgctaaacttggtggatgggaattgaaaagagatttaatgttttaaaaatcaaagtcactcagctgcagtgccacatgggaaggaggcctggatgtgaatgttcctgggagctgagagctcctgtgactgtcgccagtttcctgtggtctcccacagactcaggacatctccctctgctccaggacacctcaggaccaccagagggcactcatcgcaccttcacccctggaagggagctggtcctggggccaaaacccactgtgcctgggaagcccttcctggcttctgctctcctcaatgtatgacagccctgatttacccccagggactgttgccactcggggttgtagagtaatatgtaaccagactggagaaccacagcaatgctctctcctctgcccatcacctccccttggcccctcc

SEQ ID NO: 401020 - DNA, 900 bp, Homo sapiens
aagtttttctttactttttaaagagtaaattctctcacctcaggtagctcagagagctgcgctggaggagaaaagccagtcctggcaggagctctggtacctgggaagctggatggagagcctgggccagaatcccggacccctcacctctgcggcctagctttgtgaccttggcaaatccattctatgcacctccatttcctgtacagtggggatccttatttctctggcacagattggtatttgttctgtaaagcccagtaccactttattttattttagttattgatttttttgagacagggcctcactctgttgccaaggctggaatgcagtggcgagatcatagctcactgcagcctcaaactcctgggctcaggccatcctcctgcctcggcctcctgagtagctgggacgacaggcgtgcaccactgcgcctagctccagtaccatgtttaaacggtgctcagaaaacgtgctaaacttggtggatgggaattgaaaagagatttaatgttttaaaaatcaaagtcactcagctgcagtgccacatgggaaggaggcctggatgtgaatgttcctgggagctgagagctcctgtgactgtcgccagtttcctgtggtctcccacagactcaggacatctccctctgctccaggacacctcaggaccaccagagggcactcatcgcaccttcacccctggaagggagctggtcctggggccaaaacccactgtgcctgggaagcccttcctggcttctgctctcctcaatgtatgacagccctgatttacccccagggactgttgccactcggggttgtagagtaatatgtaaccagactggagaaccacagcaatgctctctcctctgcccatcacctccccttggcccctcc

SEQ ID NO: 401021 - DNA, 1954 bp, Homo sapiens
gctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcacctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcgggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttttgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagatgaaaaaaaaactt

SEQ ID NO: 401022 - DNA, 1820 bp, Homo sapiens
agggaaggcagaggatgcctctgtgtgtgtgagcagggtgtttggggtgagacccctactcacccccgcccctcccccagcctacaggactgtgtgcagcgtgaacgggcccctggtggtgctggaccgggtcaagtttgcccagtatgcggagatcgtccacttcaccctcccagatgggactcagaggagcgggcaggtgcttgaggtggctggcaccaaggcgattgttcaggtgtttgaagggacatcagggatcgatgccaggaagaccacttgcgaatttacaggggacatcctacgaactccggtgtcagaggacatgctgggtcgggttttcaatggctccggcaagcccattgacaaggggccagtggtcatggcggaggactttctggatatcaatggccagcccatcaacccgcactcccgcatctaccccgaggagatgattcagacgggcatttctcctattgacgtcatgaacagcattgcccgcggccagaagatccccatcttctcagcagccgggctcccccacaatgagattgccgctcagatctgccgccaggcggggctggtgaagaagtccaaggctgtgctggattaccatgacgacaacttcgccatcgtctttgcagccatgggggtgaacatggagacagccagattcttcaagtctgactttgagcagaatggaaccatggggaacgtctgcctcttcctgaacttggccaatgaccccacgatcgagcggatcatcaccccgcgcctggcgctgaccactgctgaattccttgcctaccagtgtgagaagcatgtgctggtcatactgacggacatgagttcctatgcagaggccttgcgggaggtctctgctgctagagaggaggtgcctgggcgccgagggtttcctggatatatgtacacagacctggccaccatctacgagcgggcgggccgtgtggagggtcggggaggatccatcacacagatccccatcctcaccatgcccaacgacgatatcacccaccctatcccagacttgacgggcttcatcacagagggacagatctacgtggacagacagcttcacaacagacagatctacccccccatcaacgtgctcccttccctgtcgcggctgatgaagtcagccattggggaaggcatgacaagaaaggaccatggagatgtctccaaccagctgtacgcctgctatgccatcgggaaggacgtgcaggccatgaaggcagtagttggggaggaggcgctcacctctgaggacctgctctacctggaattcctgcagaagtttgagaagaacttcatcaatcagggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttttgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagatgaaaaaaaaactt

SEQ ID NO: 401023 - DNA, 997 bp, Homo sapiens
attgattattagaaggtattagaagggctcctctggcagaaccagttttcatctactcaacaacctcttactcatgggtctttatataacttaggtgaaagtatgtccataggggaacagaaaagaaagctgagaaagatgtgccaggagacttgtgggaactaatccaagtgcaacacctccttaccacaaaggaaaaggacagggtaaaggaaattggaaaaacccataagatgtatttgaggttctttctattccagggaattcttggtatgataggacatgaaagctgagagaaaacccttctacctaggaactccggagtttcaactaccagagactgaaggcaggagagaaaaactaagacaaatgacttcaaagcctttctgaaatgccacagagggtcaggattacaatctgcctattctgattcttctactatgggaaaaaatctttttcagaattgatgtaaagcctctgttaatacttttcctgttaacaacctaactattcaactgctgaataaaaaccattaggacaactaaagaaactgagagattttggcaagaaatagtcattccaatatcaatgactacggaggaaatgcaattacttttctttgcttaagttttccaggtttgtgttcttaagtatgagccacagcatttataacaaccccagaatgtaccatttttatacaagaattaaataatagcccaaattaagtatttggctcttaggaatttgagaacttttgcaaaatgatatctttcataaaaaataaatgttgtaaaactatatatatttaataaacccattgcagtaaccagcaaaaataaatttagctttctgaaatgcgtaattgcatactgaatgtttctctagatactctctgaaacttggaaactaagtttaaaaacataaactgtctttctttaaataaataccgatgcggcagggtgcggattatatcttagtcgcggcatcgcataaaaaa

SEQ ID NO: 401024 - DNA, 1012 bp, Homo sapiens
agtgtaccaagtgcaacaaacgtttgagcattgttctgctgccaatattgaagacagccactgctttgaagtgtggggaggagagctagagcatatttgcctgccacagttagttttgtgtttccatggaatttgagcaaaactgatgcacttgtctcccaggattaatccatacaagtcacctctaaaattatcttttcccattcgttgactgagcaaaatggacttcaaggacctaaaggaggttaaataccacaagatggaggagcttgagtctctgaatcattgtgtgtgaagtcatctgccaattacataaattgaattcttggaactccggagtttcaactaccagagactgaaggcaggagagaaaaactaagacaaatgacttcaaagcctttctgaaatgccacagagggtcaggattacaatctgcctattctgattcttctactatgggaaaaaatctttttcagaattgatgtaaagcctctgttaatacttttcctgttaacaacctaactattcaactgctgaataaaaaccattaggacaactaaagaaactgagagattttggcaagaaatagtcattccaatatcaatgactacggaggaaatgcaattacttttctttgcttaagttttccaggtttgtgttcttaagtatgagccacagcatttataacaaccccagaatgtaccatttttatacaagaattaaataatagcccaaattaagtatttggctcttaggaatttgagaacttttgcaaaatgatatctttcataaaaaataaatgttgtaaaactatatatatttaataaacccattgcagtaaccagcaaaaataaatttagctttctgaaatgcgtaattgcatactgaatgtttctctagatactctctgaaacttggaaactaagtttaaaaacataaactgtctttctttaaataaataccgatgcggcagggtgcggattatatcttagtcgcggcatcgcataaaaaa

SEQ ID NO: 401025 - DNA, 401 bp, Homo sapiens
ggtgtaacttagtcatttactcttatttcttttcagatgtaaagcctctgttaatacttttcctgttaacaacctaactattcaactgctgaataaaaaccattaggacaactaaagaaactgagagattttggcaagaaatagtcattccaatatcaatgactacggaggaaatgcaattacttttctttgcttaagttttccaggtttgtgttcttaagtatgagccacagcatttataacaaccccagaatgtaccatttttatacaagaattaaataatagcccaaattaagtatttggctcttaggaatttgagaacttttgcaaaatgatatctttcataaaaaataaatgttgtaaaactatatatatttaataaacccattgcagtaaccagc

SEQ ID NO: 401026 - DNA, 604 bp, Homo sapiens
agcagtgatcctcaacatgtctatgatcaaatacgaaatttgcatttctaattctttgaggttaaatattttcataaaatgtaatgatattatggccattccaaagtgcagtaaaattctttcaatgcttattctcaatatctacactttccttttgacagacggttccccagggcatgttcactgacatcaaggtgcagaacttactttaagtagcactacgtatgagggctgtacatctcacaaacaaaacagaaagacaataactttagtaaaaagtaagttgacacttttgtcattaggtctggcagtcagtgcaggcaccatacgactcctaattctaaacatctactctcaggatggataccattcaagcccaaggaaaaccaatgcttcttttcatctatggactcaagtctcagaaagcagagaagtgagtgtaccaagtgcaacaaacgtttgagcattgttctgctgccaatattgaagacagccactgctttgaagtgtggggaggaggtaagcaaaggtagcattttcctaagagaaaaaaaaatagcttgtcaaatatttcttctttgtcagcatgactgtaataggttcc

SEQ ID NO: 401027 - DNA, 361 bp, Homo sapiens
ttttttttggttttgaaatccaagttgacacctatttaacccaatctcttgggcataatatgcaaaatacccggtgtctgccacgcccggggatgggagtacaggtatgctggagttggaaactggagggtcagagttggctgatgctctcaggagacaccaggcaaggcagccgggctgagacgcctgcacttactcctgccgtgacgggagcacctaccaaacgtgactctaaggtccccaccagtgctgtgtgttacaaggaccgtgcagggtggccgggtccatgcgagcatgtggtgcttgtgtgatttagtcttttttgggagatgaaggggcagtgggggcagatgactagagt

SEQ ID NO: 401028 - DNA, 362 bp, Homo sapiens
ttgcttttggggtgggatattggcaggtgaaagccagagcagcgccctctaaagcatgggacccagaggagaggccccttgtctgagggccgcactggtcctagagatgaatggcaaggacccacacaacctggtgtctggagaactccctaacctcatttctgttgcgctttccctcagcttcaggacctcctcctgcctccggactattctctgctggaaagctctttcccacatatccttatggccaccctcctcactgccttcaggtctttgcttcgatgtccccttcttggggaagtctcccctcaccagaatattcaaactgcaaccctctacttccaccctgcattctatcccct

SEQ ID NO: 401029 - DNA, 488 bp, Homo sapiens
gtattgaaacagtaaccataacccacagagatatccatggctacaaactacagggcagccagaattcacagaagtagtccagacaggtagcccaccaaccaaacaccaagagccaaaccaaataataactttactcacactagaaaccaacccaatttccattagaatggattgagtttaaaaataaaaaaaattaaataaataaaaaggatgcgctttgggaagaaaaggtgggaggatcgcttgagcccaggaggttgaggctgcagtgagctatgatggcctcagtgtactccagcctgaaaaccctgtctcaaaaaaaaaaagaaaagaagtgggttggtctctttcgcaatcaccattgtaaaggattttctgatattaaatacatatgctctattgtgtgtttatttctgggagaactaagaaaactgttggaaatgtgaggatttttagtgtagtcggaagctgagaataagtgatcatat

SEQ ID NO: 401030 - DNA, 642 bp, Homo sapiens
tgaatttttatccagtatgtattatctttattatatacatgtagtatatatatatgtatagtacatatgtgtatatatatgtatatgtgtatatatgtatatagtatacgtgtgtgtgtgtgtgtgtatatatatatatacatatatatatatgtatatatatatacatgaagtaaaagaactattagaagtgggttggaggccgggcacagtggctcatgcctgtaatcacaggactttgggaggcccaggcaggaggattgcttgagcccaggagtttgagaacagcctgggcaacatagtgagaccctgtctctacaaaaaagttttataaatcagtcggtggcacgtgtagctgtagtcccagctacttaagagactgaggtgggaggatcgcttgagcccaggaggttgaggctgcagtgagctatgatggcctcagtgtactccagcctgaaaaccctgtctcaaaaaaaaaaagaaaagaagtgggttggtctctttcgcaatcaccattgtaaaggattttctgatattaaatacatatgctctattgtgtgtttatttctgggagaactaagaaaactgttggaaatgtgaggatttttagtgtagtcggaagctgagaataagtgatcatat

SEQ ID NO: 401031 - DNA, 437 bp, Homo sapiens
tggtcagagcttggctcagcagtcagactgctcttcttcaaatcctggctgcattgcttactacagctgtgtgactccagatgactgaatccacctctctgtgctgcagcttcccgtctagagagatcacctggagcagagggtggtcaggagactcaatctggttactgactcacagtgcaggagtactcatcccatagtaagcatccagctagagatgttgatttctattttcaggtaataatgatgatcgtaaaattagagacagataaaaggtatgggcattaggccagggcactgcaatttctaagctgtgtgacctcaggcaagttactcgacttctctgagcctcagcggtttcatccgcaatatatggataggaaaaccgacctcagtgggttgtctgacagtggagggcacttgattaaaaaaaaaaa

SEQ ID NO: 401032 - DNA, 390 bp, Homo sapiens
acaaaatataaagccatgattctggatgagatcgtctagggaggtaatgtagatagagaaagggcttagtactaatactggagacactcaagtatttagttgtttaatagaggaggccccagcagaggagaataagaggaaattctcagagaggcaggatgaaaatcacaattacctggtgcaataaaatccaaagagaggcacgattttccagaagaagggaagagtaacatcggtcgagcaaaggaagtgaagtaagatgcagagaagtaaccactgaacttagcatgggagtcactggtgactttgagaggaggaattaatatgaacagaaaccagactggagagggttgaataataaatatgatttggtaaagagggaaatgcaaa

SEQ ID NO: 401033 - DNA, 405 bp, Homo sapiens
gaatatttcccaactcatttataaggcatgtttgccttataaataacaacaatacctaaacatgacaaggatgttacaagaaaattattagccaatatctctcataaattatagacgtaaaaatttcaaatgatattagcaaactgaatccagaaatatataaaagaatagcatatcataattaagtgtttgcagtgtattccaggaatgcaggtttggattaacatccaaaaatcaaacaacataattcactatgtatagataaaggagaaagctatataattatctcaatgattttgggaaaagcatttgataaaattcaacactcaaacatgagaaaatcctctgcagactaggaataaaagggaacttcttttacataataagagattttacaaaaaaaaa

SEQ ID NO: 401034 - DNA, 478 bp, Homo sapiens
ttgtatatcccttaacgaatgatccttgagtgcatgatctgtttcagccactgttctaagctttagaggcccagctgtggatgatgtaaacacattctgaaagggaggcagattataaagaagtaatattaaggtgatgtgcttctcttccacacctcacatttctatttagggaaggaaacctctatgcccctggataaaattgttttagagtatacctgcctctctctttcccctaatttatatgatttgtgaaacaggaaagagaaactgagggtgacctttctctgttctctgtttcacctgcatgcatttctatctgcttgggattaaggtatcaggagcatgttcagtcccatttggaggtggggaaggggtgtcagctaatggttgtgattttaatttggagagaaactttgttgaaaatataaaccatgcttttcaacagactttattaataaaatacctttttgaatta

SEQ ID NO: 401035 - DNA, 395 bp, Homo sapiens
gtctttacaggtaaagtggttttcctgtagccagcatgtagttgggtcttgctgctttatacattcagccactctgtgtctgttaattggaaaactgcgtctattaacattcaattttcttattgataagtaaggagtaccatgttgtttgtttttgggttgttttataactcctcttcctttctttcattctcactctcttcctttctttcattcttactgtcttcctttgtagttaagtgattttccctggtagaatgtttaatttgttactgttttaaaaaaaatacatgctacaggtttttgcaatgtgatttccatgaggcttaggaaaaaacatcttatagatgtaatgacttattttaaagagatcacaacttaaaacaaagaataga

SEQ ID NO: 401036 - DNA, 564 bp, Homo sapiens
agattatcatattcataattctctgagatagcttttattactccattccatagacaaagataccaaggataacagaggttaagtaccacaattaccatgtcatccgtctgactccaaagtccttgttcttaactactgcaccacggtacctctccgtaacaatgattacacccatccataatcaaatctgaatctagtatgttaatcaaactttatgtcataagtactattttcagagcaaggtttaataaaacattgatataatccatttaatcagtgcttacttataatttgctattaaaatcttttatcactatttttaactaactttaaatttacgattaatctatttatgagaagtaacagtgactcatttcagtcaacctcaatatttcacttgccttaaaaataatgaatgtattcagtctttattctattatttgattttcctagatatgactgattccacatatataggcttttatattataggatcttagtttatttctaatatgattctaaattagaggcattggggaaaatttttcaaagaatttggtccca

SEQ ID NO: 401037 - DNA, 449 bp, Homo sapiens
gtaaatgtactgccttagttgctgctggtgtaaaatgaagtctaagcctgacctccccgtaaacagcagtgatttccaggtggattaaagatctaagtacacaattacgaggacaacagaatgcagccgggtgtgctggcacctgtggtcctagctacttgggcgtctgaagtgggaggatcacttgagcctgggagttcaaggatatagtgagccatgattgtgccactgcactccagcgtgggggacagagcaagaccctgtctcagaaaaataagaacgtcaacaaaggatagtagaactggaaaaggggccgggtgcggtggctcatgcctgtaatcccagcacattgggaggccaaggtgggcggatcacgaggtcaagagatcgagaccatcttggccaacatggtgaaaccccatctctactaaaaatacaaaaattacctg

SEQ ID NO: 401038 - DNA, 600 bp, Homo sapiens
tttctctagcttaccttattgtagaatgtgctatataatacatataaaatacaaaatatgtattaatcaacagtttgtgtcatctgtaaggcttttgggcaatagtaggctattagtggtgaagtttttgtggtgtgaaagttatatgtgaattttcacttgcagtgaggtttggcacccatacctcctatgttgttcacaggtcaattgtgtatcacaagtaatactagttagaagtattcaaatgaaagtattgctgcttgtattatcactaagatttgggtacttatcactgccaataactttcacttcatttataatagtaacattggaaaggaggcgctctcaaatacttgacgtccttcttctttgctattttatctattaattgttttttaattgtctttaagctttccctcattgatccctctcagaggtatatctctataacctaattgcccaatatattccacatgtagctatgtaaatttatattcaaattaattaaaactaaagttaaattataaattcagtttctcagtcatactgattacacttcaagtcctccatggcctccatgactttttcaaaaaaaaaaaa

SEQ ID NO: 401039 - DNA, 440 bp, Homo sapiens
ctgggaaattggtaagtaaaataggacactttgtaaaatggattattatgcagccatgaaaaccagcagtaactctatgcattctgacacagaactatgtctaagatatgctatgctgttgagtgaaaaatgaaactttcactgaagtgtttctaaaatgacaccacgaatcaaaataaacagagtgaaaacacacacattctgcatgcaaaaacactcaaacatacatatacgcatgtggatatgtatgcttacaaataaatagactattttggaaagcatacacaatctggtaacaatgtttacttcaggagaaaaaatactgagagtgttgggtgtgaatgtggggtaggtaacagcagaataattttttcattttttttttctgattcaaataagaatctatgcatcattaaaaaataaactagttgatttttaaa

SEQ ID NO: 401040 - DNA, 589 bp, Homo sapiens
cggagctgccttcctgcagttcaagagcactgtctcttttctgggcctcctgcctggtgcaagggccccagctgagcctcctccagctctgacctctggtggttccgggctgccccagagggtcttgcccaggctctgacacttggcatggtctgggagctccagcagccacagcccagccctggggaggctttgtggtctctgagggggcaggtgcactcccccaactccagttcatgtttttccctccaactctaagcctttttcttcctctgctattacccaggcaccctaccctgtcaacaacactggccttcaagaccctttgtagcataactcccacctataactcccacctgaagccagcccttcccacctctgcgcctctgatgcccaggacagctctgaccatgggcagctctgacccaggacagctctgaccttgggcagccctgatctggggcagctctgacctcgagtagctgtgaccctgggcagctctgactctgggtagtcgtgaccctggggaactctcagcacgggggttgcatgctcctgtttagacagctgctgtcccccaagctggctc

SEQ ID NO: 401041 - DNA, 165 bp, Homo sapiens
tcctactagctgtcggcaacaggctcagccctaccctcagaaggcgccctaaaaaacctacagtgtagaagagcacaccagacagtgtgctctgcaagaaggatggctcctaatctgaaaaaaggtacaagttcctgtccagggctcaccaatcaggaaactcat

SEQ ID NO: 401042 - DNA, 291 bp, Homo sapiens
cccaccccaacccacccccagctcctagtaactaccattctactctgtgctttatgaattcaacttttttagattccacatataagtgagagcatgcagtatttgtctttttgtgcctggcttatttcacttaatataacgtcctccaggaaaatgattcctgatgctcttaagaaaagcgtccttttcatgtgtcttttggctgcataaatgtcttcttttgagaagtgtctgctaaaacttaaagtataataataataaaattttaaaaaaaggaaacatacaccttga

SEQ ID NO: 401043 - DNA, 468 bp, Homo sapiens
  misc_feature (7)..(7): n is a, c, g, or t
  misc_feature (95)..(95): n is a, c, g, or t
  misc_feature (109)..(109): n is a, c, g, or t
  misc_feature (120)..(120): n is a, c, g, or t
  misc_feature (147)..(147): n is a, c, g, or t
tttgggnatgtgtcaatgccatggtcagatatgtttatgacgccttctataagggtttcacttttttccccttttctttaatccggtaaatgtanacggttttttgttntgggttttttngggttttttgtctttgttttgtttcgnttttttaaatagggtctcactctgtactccggcctgggtgacagagcgagactccatctcaaaaaaaaaaaaaacagaagacaaccatgtgaaggcagggagacacagagacagcaccatgtgacgacagaaaattggattaatatatctataagccaaagaatgccagatcgccagcaaaccaccagaagtaaggaagaggcaaagaaggattcccctacaggtttcagagagggagcatggccctgctgacaccttgatttggacttcttcccactagaactgtgatacaataaatttctgctgtcttaagccactcag

SEQ ID NO: 401044 - DNA, 718 bp, Homo sapiens
agagccgtcatctctccggtgcccgggagaggggccgggcgggacggtacagcaaccggaggaaccttgattccctgccccgcaagcccagcaccggttttgccgccttgtctcgaagggtcaaccaggccatctcctgcctcgggacggagagcgccctggaaaaggcggaggggccgaccttagtcacacaagagcgatggcaagattttcacccaagccatctgacttggaacccatggattaaccaactgccactggaggcaaatccagagaccaagggagcagtttatacagaaacagaaaaattagccgggcatggtggtgggcgcctgtagtcccagctactcggaaggctgaggcaggagaatggtgtgaacccaggaggcggaggttgcagtcagccgagatcgcgccactgtactccggcctgggtgacagagcgagactccatctcaaaaaaaaaaaaaacagaagacaaccatgtgaaggcagggagacacagagacagcaccatgtgacgacagaaaattggattaatatatctataagccaaagaatgccagatcgccagcaaaccaccagaagtaaggaagaggcaaagaaggattcccctacaggtttcagagagggagcatggccctgctgacaccttgatttggacttcttcccactagaactgtgatacaataaatttctgctgtcttaagccactcag

SEQ ID NO: 401045 - DNA, 235 bp, Homo sapiens
aagaaagatgaaaagcagattccaggaactaaggaaggatgaatcttggggaaagtgtttagttttagtgtgaaactgtcaagccgcttgctccggtggaaactcagggagaaaaacaacagtgagaaagactagcgaaatagcaaggaaccagacggcttgcctgagagagtctgtgcctccgggcaatttattaatagaagactgagatgcacctactcagcaaaaaaaaaaa

SEQ ID NO: 401046 - DNA, 750 bp, Homo sapiens
  misc_feature (235)..(235): n is a, c, g, or t
gtttattaatccttggaaagaattacatagcggttattcacagcttgtaaattacaatagaaaggttcctttcaaatggtagagttgcactaaagaggaaattgggtttataagaaaatggaggcaaagaacttaagttttaagaaaaagcacttcaaaacagaagggcaaatggaaaagggggatataaaacaaaccaataaaaataccatctgagggtgttactgtccaaaantaaagaataagatgcatcactaagccctttgcactcgtgttgacctcgtaagtaaaaattattacttagaataataataagtggtgcacactacattccctgtccctcttctagactttttttttgtagaagaatcagaaaacaatttactaacctccctgtttgatattaaaaactcaataggaaggtttttaatattttctgtcagtacaagttgaacttgattgtgtcaactgaaaccctagaggtttgtgtatcagtagaatgcaagaacattgttaaagttgcttacaatcttttttgttttcctttccattccattgtatcaattttttgagtaactttcaaatggctagaaaatggtctttttgctttgcccttttatagctgaaataaccagctccattcttttcatgagtagtaagttgatatatttatttatcaggtatctttcagttgtcactaaatactgtagttttcttgtgttgtatggaaattatagttcaattattcta

SEQ ID NO: 401047 - DNA, 433 bp, Homo sapiens
caccatgaagtactttgaacttcactaaatggggaaaatacaagacactacatttagaaattgtttaggagcagcaaatggagagaagcaacatttttgctttaaaaaaaaacaacatcacaaccccttgattatgtgcagcacacaatttaacaggtgtgtgatttattcatttattcacagactcatggaccaaccattccatcacagcactattgtctgtgaagcaaaacacatttacagcaaactgtatcagctcctcagagagactgaattaacccatctaaaaatcctttgcttccgattgaaaaagagggttaatatcatccaaatgatgaacataaataaactttacctcagtaaagttctttccatctttggatttctgggtcatctctaaccagtgcttgatatgaaagggggaaaaataaaa

SEQ ID NO: 401048 - DNA, 394 bp, Homo sapiens
aactatgcttctcatccctgtctgtgtactgcttagggaactttctgaaaacctagattttttaaatatatagattcttgggcccatcccagatctcttggattacagtctcttatggtagatctcaaatatctggctcctcaagtgattctgatgcacagccaaggtttgaaaacagctgctttggacgggtgcagtggctcacgcctgtaatcccagcactttgggaggccaaggagggcagatcacctgaggtcagcagttcgagaccagcctgaccaacatggtgaaacactttctctactaaaagtacaaaaattagacgggtatggtggctcatgcctgtaatcccagctacgtgggaggctgaggcagaagaatcacttgaactcag

SEQ ID NO: 401049 - DNA, 769 bp, Homo sapiens
gcttgtctagactgtagaatgttattttttgggggagaactaatggcagatgaacttagtggtcattatggttggatggaaaaaaaatagagtgaacagatacagctttctcacagaactttcatagaccagataactgcttcaagagctgacctgaagtaaggaggagtattatttcctatcttgagggatggcagagattttcaatttgacctttgaatatattttctgtttggtcatagtcttgtgttttagagtaagactcattagatttctgtgattttgaccacctcaggcacatagaagaaagaaaaaatagagggagattttttataataaagtgaatgagttaaatgatattttgaaggtgtacaagaaaaggaatggatcaaaatggctttcattagttacattttcttcttgacttttgtcacaagagaaaaggtcttatgaagaatggttctgcctctgttgtctgtcaggtagcttaggatcttttatgtaagaatctctgttcctagcactttgggaggctgaggcgggcggatcacgaggtcaggagatcgagaccatcctggctaacacagtgaaaccccgtctctactaaaaatacaaaaaattagctgggagtggtggtgggcacctgtagtcccagctaacttgggaggctgaggcaagagaatggcgtgaacctgggaggtggagcttgcagtgagccaagatcacgccactgcactccagcttgggtgacacagcgagactccatctc

SEQ ID NO: 401050 - DNA, 329 bp, Homo sapiens
gagaaaatattttcaaattatgtatcttagaagggacttaatttccagctgggcatggtggctcacgtctgtaatcccagcactctgggaagccaggtgggcggatcacctgaggtcaggagttcaagaccagcctggccaacatggtgaaaccctgtttctactaaaaatacaaaaattagatgggcgtggtggcacatgcctgtaatcccagctactggggaggctgaggctggagaatcacttgaacttgggaggtgggggttgcattaagccgagactgtgccaccgcactccagcccaggcgacagagtgagactccatctcaa

SEQ ID NO: 401051 - DNA, 319 bp, Homo sapiens
ctcatcagaactagatcttgtgagaactgcctgagcagaccaagcagcacagaggccacagtgagacacatgagggagaaggtgaacccagatgaggctcatcaggaacagatcttgtgggaaccagagaggacaaccccggatgaggtccatcagaaccagatcttgtgggaactgcacttcaaagtgctacagacccacaaacactacatgcagcatcacatgaatgccctctgcaagggtgaggggcctggcaggatggaggaaataccagagaggggggatgcgccctgaaaaaaaggagagccctggggactgc

SEQ ID NO: 401052 - DNA, 1082 bp, Homo sapiens
gggtatttatccgtccccaatttccgtgtcgagggtgtccccccaacccccgtgtaggatgccgaatggttataccacccgggaattttttccccctagaggatccctttactatgtgcatctctggggaaccttcagaccctatggtattccccaagggcctcttataatggacccgctgatattggggtcacctagactgggtgagactttcctcaggccctactctgcagcccaggaattacagtgttgtccccagggcgacacaaaagggaatgcgaaactaaatgtcacaagggcaccaaagaataattggtgggatccatgaagaacatttcccagcaggagccataatgcgggcctcgggactacacctaccgaatgtgatttagaccccgctagacactggtacatgccgaaagggggtaacaaagggcaaacttaaacgagacaccacgtcttgcccccgacgtggaagatttctagacacccccccgaatagaagaaatagacatagataaacaaccatagtgcccatagcttttttttttttttttaaaaagggcagggggtggggtatttagtcacaagacatagaggaactttaagtgtatattgctaagtgaaagaagttagtctgaaaggctacatactacatgatttcaaatatatgacattctggagaaagcaaagttagtaaagactggttgccagaggttcagtgggagagagggaggggtaaatacatggagtagagatttttagggtggtgaaactactgtatacaatactataatagtggatacatgacattatatattggtcaaaatccataaagacatacaacaaaaagaggacccttcatgtaaattacaggcttcagctagcctggatgacagagtgagactttgtctcaaaaagtaaagtaaaaatgtgtcaatattggttaaacaaatataccacactagtgcaagatgttaataataaaggcctggggtggggggaagcataggggaactctatactatctgctcagtttttctgaaaatctaaaacttctaataaagtctattaaaattatg

SEQ ID NO: 401053 - DNA, 730 bp, Homo sapiens
aagagcatgcaaattaaatgactccacatcagtcagtacagccacagccttcacttcggggcttgttgactgttgtctgttcttcagactcggatgctgcgtggggtagctctttctgagtccccgcttaggaggactggtcctggtagaacagcgagaggggaagtcgtccttctcaggcagtggctgggattgccatttgcactgcttgagggttttatattaccatcgtgtgggtttgcttttcttcagtcctagtctcagaatctaccttctacttcacacttaaaattctgagagcagttggcaaagctttgccttctctgtctttgtcggggcaccaataacagtcatgtttgattttctggaggaattgatagaaagattgggcgtcagctaaagccaaataaaacattatagcagtatctgtggttattagaatatctgaaatctcatctgatgcccttacctataaacagtttcacaaatcccacacatggcctagcccacctcttcatgtcgcccatgaagtagctccatccacagggcccagatccctcccacacatggcctagccctcctctccatgtcacccatgaagtagctccatccacagggcccagatccctcccacacatggcctagccctcctctccatgtcacccatgaagtagctccatccacagggcccagatccctcccacacatggcctagcccacctctccatgt

SEQ ID NO: 401054 - DNA, 573 bp, Homo sapiens
agagttagccattcccccaggtatgctggaaagagaccttatatgcacttctgtctagtgaatcgcttacttatcaggtttttcgcaaaagtaaaagttgtgaacagttagccatgtaacatgttcttgagactactggaaaagcagtcttacatgtaaggtacgcaaggaaagtagaatgtgcttttgttaaaagattgtaagaaggtatgggaatgtaagttttgcctagtttggagggttaaaggattgttttatgttagataggataaagctgaaggtttgagcaagttgtggaaggtttgtgaaaaattaatcctataaaagaaattctatgtgtgaaaattacccaaaattaaaggacttttattcagtttattcataaacactggaattaaagcacaacatagttttattaaagtattaatctgcttttgattaaagtgttatcagtacatgttccaaaattatgtgaaactcctataattctaatgtaacatagtatacattattaggaataattataattatgtttaattgttttgtgcctcaggggtaataaatttctttgtc

SEQ ID NO: 401055 - DNA, 380 bp, Homo sapiens
ggagccaacctgaagatctaataaagacctaataaagctggaacaatttgactaacaaaataatgatagtattggattttaattcatgtactaaaatactcatgagtccatgctgatgtaagtattttaataaataaatggtggagaaggcactggttttggttttgtattttttttacaggagcatcccaattaatgtagaaagaaagacgggaaaagaaatttttcattaggcaaataccacggtaataaatgtggcagacaggacctgctgatggatgccaaaattaggtcagagtttgaggagaaaagagtatttgcacagtctcaaagtattccctaccccctctcctcccaggatatttttttaactgcaaagg

SEQ ID NO: 401056 - DNA, 318 bp, Homo sapiens
tcaacagccacagcattttgcaagtgtttctttgaaaacttgcttcactgtgtttttcaattttttttttaaacaacacttaatactgccagacaacaattcagacagtgtgctttttgtttataaagaacaaggaagggctactggaatctcacttgtcctttgaaacttttgctgaccaagtgtagaagtgagggcatgccttctgctcacccacaaaacacaccctgtgctccactggaccttcaaaccagtggaaagacccaacgctttttgttttatctagccaaaatttgcttatgcttacccaaaacctga

SEQ ID NO: 401057 - DNA, 459 bp, Homo sapiens
gggtaggcaactaatcacctccagggtccggagaaggcctggggcatagacgggaagggctttagatccccaacagaccccacacagacgcaagggtcctgcacgtagggccatggccttgacgatagagtcagtgttagctgtgtaagcctcaggctggaccactggggaatgagtccccgctccactgcacaccagcgaggggacatgtgacttgttctctgcacctcatgttttttctgtaaagtagaaatgataatattgggtcgggtgtggtggctcacacctgtaatcccagcactttgggaggccaaggtgggtggatcatgaggtcaggagttcgagaccagcctgcccaacatggtgaaactccgtctctactaaaaacacaaaaattagctgagtgtggtggtgggtgcttgtaatctcagctgctcaagagattgaggcaggagaatt

SEQ ID NO: 401058 - DNA, 383 bp, Homo sapiens
ggcatcacttttcttttcccactcactgggattcagcactcacccagagccatttcctgtgaattcttgtgggaccggatctttttccttcctcttgtaaaaaaaattctgaccctacgccatggcttaactttgatttccaaatttaaatgtataaaaccaatgttatttgggatgagtgaataccaggatggttgaagaggtggaagcaagatgaaggcagccgagcaacccctggaagctgagaaatcccggagtgaatcctccttgggtctgtgccccaccttgggaacaaatcaaccgcactgaactctttcgggccataagggggccattcactccatgatttctgcaggatgtatttatacccttgaagaagctta

SEQ ID NO: 401059 - DNA, 347 bp, Homo sapiens
agaggttgtactgggttgagagagaggcctcagaatcaagaccttgtctcctgccacagtttccctggtgaagctcccaggctgagcacaaacttccaggtcgagcacagaagtttcgacctggaaacttcagccctcagagaggaggtggcactaacgctctaggtgggcggctgctctatggtcttctgctgcctggagagctttgcctccatcactggtgcccacctggggaatgctcaggaactactcttcaaaagtacactcggatgcccactctgcaaagccattttgtttccttattgtacctctgaaatcatttgttaaccaagcatttgcaaatccgt

SEQ ID NO: 401060 - DNA, 515 bp, Homo sapiens
aaattcctagacacatacaaattaacccaggaagaaatacaaaacctgaacagaccaacaacaagaaatgagatagaagccataataaaaattctcccagtaaagaaaagcctgggaccccgtggcttcactgatgaattttaccaaacatttaagaagtaacaccagtcctactcaaactattctgaaaactaaaggaggagggaatacttctaatctaattctacaaggccagttactctgatatgaaacccagcataagacacatccaaaaaagaaaactacaggtcaatatctctgataaatattgatataaaaatcctcaacaaaatgctagcaaaccgagttgaacaatgcattggaaagatcattcataatgaccaattggggtttatcctcaggatgcaaggatggctcaatatatgtaagatattgatggttcaataatcaatcaatgtgatacttcatatgaacagaatgaaggatgaaaaacatatgatcatttcaactgatgt

SEQ ID NO: 401061 - DNA, 706 bp, Homo sapiens
ctggatcatagggtagattctatttttaggtttttgaggaaactccatactgttttccacaccagctgtactaatttacatacctattcacaatgtctgtgttccgtttcctctgcattatctctaacatatcattcacctttttgataaatgccactccaacaggtgtgagatgatattcattatggttgtaatttgcatttccctaatgattagtgatgctgagcatttgagaaaagctaatttttaatgccttaatgttgagaactgacttaacattgggacagatacgaagcaatagggtaaaagcaaaacaatgtcattcaaacaagatatcagatttgcacagaggcctttgtggggcagatgggaacccagcacacaaaaagttgaattatatgaagcaatatcacaagtgagttaggaaatgtggaaaaaaaaaccaataagacagatataattaaaaatagacctaatggattcacactatcactacaaatactggaagccctggggtttcatttgggggaaataaatacttgctttcatacatgatcaaaactaatgaaaaggctagatcctgagttacttttcaggcatttacatttaaaacttaaagttacatatgtatacatgtgccatgctgtgctgcacattatgcacatgtaccctaaaacttaaagtataataataataaaataaaaaa

SEQ ID NO: 401062 - DNA, 328 bp, Homo sapiens
caattaggtcctgattacaacactttgagccccatgagcttccttaaatcaaaagacttgctctggacactcatcacctcactgctggcttattctgcttcttctgtagactccctgctaccctgtccatctggcagaacactgggcaaaagaggttctgattctggcctgttacttgctgtacaaacttgcacaaggccagagaggactctcttttcccatctgcaaagtgggaggttgaactagagtgaactcttgatattctctgatactccaccgctagattaattttttcctaaaatgccccaatgattataccactccctta

SEQ ID NO: 401063 - DNA, 741 bp, Homo sapiens
taaaaataatcaaatatctgcacatttctcataattttttaaacagttgaattgttaaaatcaatatccatatatagtctacatagtgcctttgtttgctaaatctccgaatcttctttcaatctataggctcctctctttgcattttatttgttgaataaactggattgtttgtactgtagattttccacaatctggattttgctgattgcgttcccacacagttgtctaacatgttcctctgttgcttgtatttcctataaatgagtagtaagatctggaggcttgattcaattctggttagatttttttttttttttggaggtgggaagaatactttataggtgatactgtatagttcctaatgaatcatgtgtgaaggcagaaaatgtctagttgtttatttttatgatataaagataggtcttaaaagtacctttaaaattttttgttttttttaattgacaaataatagttgtacatattcttggggtacatagtgatgtttcaatatgtataatgtgtaatgatctgatcagggtaattagcatatccataatctcaaacatttatcatttctttgtgtttggaatcttttttttttaatttaaaagtaaactttagcacaccaacatggcacatgtatacatatgtaacaaacctgcacattgtgcacatgtaccctaaaacttaaagtataataataagaaaaataaatgtgaacataaactaaaaagaaaa

SEQ ID NO: 401064 - DNA, 332 bp, Homo sapiens
tggggaagctgaaggaagaacagagaggttgcttgccttgtgtttaggggttcctggacacatgtctgggcaaaagcaaatgaggctggtacagttcccagccaacactgagcccaggcccacatcagtttccgcattccctgacctctcgtcttccacaattttagtagccaagtgtcctttccctaaaaccaaggatgtctgccctgcttggacacaaggcctctctccaggcctggcaggccactagacagcttgtggtgggccagtgtggctcttagcactgggttgctggggttggtgcaagaatgtcagagatacgctgcagaggc

SEQ ID NO: 401065 - DNA, 235 bp, Homo sapiens
cccacactcaggctggagcagcattctggctttgtttttgttttgctttattgctctgtgtctaccagacacacagctcctcagaaactggacagaaagcctcctgacatcaccacaacaaaatcacagccattaagtccaacgggattgctttatggtggctcaagcccatttctctgagctccaaagccatcctgacatcattatgctgcatcattatgaagccaacacacat

SEQ ID NO: 401066 - DNA, 767 bp, Homo sapiens
ttccagttccgcgactcgcgggcccctcctaatgtcagggacttaagattggggctcgctgggacctggtggtccggttatgggaaaagaagcctcgtgggagagcagagcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtgggaccaatcaggttgaagtaaagatatatagagaccggacttacagtttgaaaaaaagaaagtagagtgcccactggaacccactggagcccactgtacctatgcccacaaaaggagaagaaaccttttcctgggagcccgctgactatacagaggacaaaggcattcttatgccaggccttgctcctttatctgagcgagctggagggcatcaccccttcaaacatgatgtattccttttagaaaaggaaaaaaagcttgatataatgaagacagcaactcaaagaaaagggaaatcaggagacttggtatggtctaatgcctggtagatagcagccaattggaccacctcttgatttatctaggcatggaaatcagagatcatg

SEQ ID NO: 401067 - DNA, 2897 bp, Homo sapiens
ttccagttccgcgactcgcgggcccctcctaatgtcagggacttaagattggggctcgctgggacctggtggtccggttatgggaaaagaagcctcgtgggagagcagagcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtggggcatcaccccttcaaacatgatgtattccttttagaaaaggaaaaaaagcttgatataatgaagacagcaactcaaagaaaagggaaatcagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacaattgtgaggaatgtggaagggccttcatacatgcttcccatcttcaggaacatcagagaattcatactggggagaaaccattcaaatgtgatacatgtggtaagaacttccgtcgtagatcagcacttaataatcattgcatggtccacacaggagagaaaccatacaaatgtgaggactgtggtaagtgtttcacttgtagctcaaaccttcgtatccatcaaagggtccacacaggagagaaaccttacaagtgtgaagaatgtggtaagtgctttattcagccttcacaatttcaggcccatcggagaatccacactggagagaaaccatacgtatgtaaagtgtgtggtaagggtttcatttacagttcaagttttcaggcccatcagggagtccacactggagagaagccatacaaatgcaatgagtgtgggaagagcttcagaatgaaaattcattatcaagtgcatctggtagtccacacaggggaaaaaccctataaatgtgaagtatgtggtaaagccttccgtcagagttcatatcttaaaatccatctgaaagcacatagtgtacagaaaccttttaagtgtgaagagtgtgggcagggcttcaatcagagctcacgacttcagattcaccagctgatccataccggtgagaaaccatacaaatgtgaagagtgcggaaagggatttagtcgtagagcagatcttaaaattcattgtaggatccacacaggggagaaaccatataattgtgaggagtgtgggaaggtcttcagtcaggcctcgcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggagtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcttgtaagtcatcacaaaattcatgctgctggtacattttatgaaaatgatgagaatagtaagaacatcagagagttgtcagagggaggaagttctacaaggtgattaaaaaaaaaaaaacagaactcatgtacaacctgaatgcttgtaattagatttcataggagggaaaaattttctttatcaacctctttgaatttatttgatttgtaacgctccacatttccacctagacttttttttgttttttattttttgttttgaaaccccatctctactaaatacaaaaattagctgggcatggtggcaggcgcctgtaatcccagctactcaggaggctgaggcaggaggattgcttgaacccgggaggcggaggttgcagtgagccgagactgcgccattgcactccagcttgggtgacagagcgagactccgtctcaaaaaaaaaaagacattggttagaaatgtaattttagtaatgcaccaagatgtaacagtttttctgttgtttgagttaacacctggagtttttttgttttatttttaagaagattaatgagtgcagacagaaatgtgaggttagagtgaaggtttaataagcaaaagaagaaagctttttgccagcagagagggggacccaaatggaattccccctatga

SEQ ID NO: 401068 - DNA, 2827 bp, Homo sapiens
  misc_feature (28)..(28): n is a, c, g, or t
ctccagggaagagggggcgattgtcacngcacattccacgcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtggggcatcaccccttcaaacatgatgtattccttttagaaaaggaaaaaaagcttgatataatgaagacagcaactcaaagaaaagggaaatcagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacaattgtgaggaatgtggaagggccttcatacatgcttcccatcttcaggaacatcagagaattcatactggggagaaaccattcaaatgtgatacatgtggtaagaacttccgtcgtagatcagcacttaataatcattgcatggtccacacaggagagaaaccatacaaatgtgaggactgtggtaagtgtttcacttgtagctcaaaccttcgtatccatcaaagggtccacacaggagagaaaccttacaagtgtgaagaatgtggtaagtgctttattcagccttcacaatttcaggcccatcggagaatccacactggagagaaaccatacgtatgtaaagtgtgtggtaagggtttcatttacagttcaagttttcaggcccatcagggagtccacactggagagaagccatacaaatgcaatgagtgtgggaagagcttcagaatgaaaattcattatcaagtgcatctggtagtccacacaggggaaaaaccctataaatgtgaagtatgtggtaaagccttccgtcagagttcatatcttaaaatccatctgaaagcacatagtgtacagaaaccttttaagtgtgaagagtgtgggcagggcttcaatcagagctcacgacttcagattcaccagctgatccataccggtgagaaaccatacaaatgtgaagagtgcggaaagggatttagtcgtagagcagatcttaaaattcattgtaggatccacacaggggagaaaccatataattgtgaggagtgtgggaaggtcttcagtcaggcctcgcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggagtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcttgtaagtcatcacaaaattcatgctgctggtacattttatgaaaatgatgagaatagtaagaacatcagagagttgtcagagggaggaagttctacaaggtgattaaaaaaaaaaaaacagaactcatgtacaacctgaatgcttgtaattagatttcataggagggaaaaattttctttatcaacctctttgaatttatttgatttgtaacgctccacatttccacctagacttttttttgttttttattttttgttttgaaaccccatctctactaaatacaaaaattagctgggcatggtggcaggcgcctgtaatcccagctactcaggaggctgaggcaggaggattgcttgaacccgggaggcggaggttgcagtgagccgagactgcgccattgcactccagcttgggtgacagagcgagactccgtctcaaaaaaaaaaagacattggttagaaatgtaattttagtaatgcaccaagatgtaacagtttttctgttgtttgagttaacacctggagtttttttgttttatttttaagaagattaatgagtgcagacagaaatgtgaggttagagtgaaggtttaataagcaaaagaagaaagctttttgccagcagagagggggacccaaatggaattccccctatga

SEQ ID NO: 401069 - DNA, 1014 bp, Homo sapiens
  misc_feature (28)..(28): n is a, c, g, or t
  misc_feature (987)..(987): n is a, c, g, or t
ctccagggaagagggggcgattgtcacngcacattccacgcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtggggcatcaccccttcaaacatgatgtattccttttagaaaaggaaaaaaagcttgatataatgaagacagcaactcaaagaaaagggaaatcagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacagaacactacagggagccccctgaaacactgcaaatntttgaaagctgagtgtacaaaagtcaa

SEQ ID NO: 401070 - DNA, 385 bp, Homo sapiens
gagactgtctcaaaaaaaaaagacattggttagaaatgtaattttagtaatgcaccaagatgtaacagtttttctgttgtttgagataacacctggagttttttgttttatttttaagaagattaatgagtgcagacagaaatgtgaggttagagtgaaggtttaataagcaaaagaagaaagctttttgccagcagagagggggacccaaatggaattccccctatgaggcaggggtttggggtttttatggactgggaaggggaaggaatgtgcttagtttgtgggctattttggagaaagtgtgacttagcttggcccggaaccttggcccaggaccaatcaggttgaagtaaagatatatagagaccggacttacagtttg

SEQ ID NO: 401071 - DNA, 401 bp, Homo sapiens
tgccctgaatgtgggaaaggctttatttgtaggcgagatctttatacgcatcatatggtccacactggagaaaagccatacaaatgtggggagtgtggaaagggcttcaagtggagcttgaaccttgacatgcatcagagggtgcacacaggagaaaaaccctatacatgtggggagtgtgggaagcacttcaaacacaggtcatatctcatgtggcaccagcagactcataccggagagaagccctatgagtgcagtgaatgtgggaaggtcttcttggagagtgcagccctgattcaccactatgtcattcacacgggagagaaaccctataaatgtaaggagtgtggtaagggcttcagtcaggcttcaaatcttcaagtccatcagaatgtccacac

SEQ ID NO: 401072 - DNA, 2405 bp, Homo sapiens
  misc_feature (28)..(28): n is a, c, g, or t
ctccagggaagagggggcgattgtcacngcacattccacgcctgaaaaaggactgcgcggactgacttcttggctactgaaagcaaagctccactgttccaggcacgattctgccttctctcaaatggcataactcaggactctgcaaattcccagaaacaggaggaaaaatgaccacattcaaggagggactgaccttcaaggatgtggctgtggtcttcactgaggaggagctggggctgctggaccctgtccagaggaatctgtaccaagatgtgatgctggagaacttcaggaacctgctgtcagtggggcatcaccccttcaaacatgatgtattccttttagaaaaggaaaaaaagcttgatataatgaagacagcaactcaaagaaaagggaaatcagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacaattgtgaggaatgtggaagggccttcatacatgcttcccatcttcaggaacatcagagaattcatactggggagaaaccattcaaatgtgatacatgtggtaagaacttccgtcgtagatcagcacttaataatcattgcatggtccacacaggagagaaaccatacaaatgtgaggactgtggtaagtgtttcacttgtagctcaaaccttcgtatccatcaaagggtccacacaggagagaaaccttacaagtgtgaagaatgtggtaagtgctttattcagccttcacaatttcaggcccatcggagaatccacactggagagaaaccatacgtatgtaaagtgtgtggtaagggtttcatttacagttcaagttttcaggcccatcagggagtccacactggagagaagccatacaaatgcaatgagtgtgggaagagcttcagaatgaaaattcattatcaagtgcatctggtagtccacacaggggaaaaaccctataaatgtgaagtatgtggtaaagccttccgtcagagttcatatcttaaaatccatctgaaagcacatagtgtacagaaaccttttaagtgtgaagagtgtgggcagggcttcaatcagagctcacgacttcagattcaccagctgatccataccggtgagaaaccatacaaatgtgaagagtgcggaaagggatttagtcgtagagcagatcttaaaattcattgtaggatccacacaggggagaaaccatataattgtgaggagtgtgggaaggtcttcagtcaggcctcgcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggagtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcaggtaaccatccttctactatctccatgagttcaattgctttaatttttagctcccacaagtaggtaagaacatgaaaagtttgtccttctgtgcctgattttgcttaacataatgacctccagttccatccatcttgttgcaaatgaaaggatctcattcttttttatggctgaatagcactccattgtgtatgtgtaccacatttacttttatccatttgtctgctgatgggag

SEQ ID NO: 401073 - DNA, 914 bp, Homo sapiens
gcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggagtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcttgtaagtcatcacaaaattcatgctgctggtacattttatgaaaatgatgagaatagtaagaacatcagagagttgtcagagggaggaagttctacaaggtgattaaaaaaaaaaaaacagaactcatgtacaacctgaatgcttgtaattagatttcataggagggaaaaattttctttatcaacctctttgaatttatttgatttgtaacgctccacatttccacctagacttttttttgttttttattttttgttttgaaacagaatctcgctctgttgcccatgctggatgcagtggtgctatctcagctcactgtaacctccacttcccgggttcaagtgattctcctgcctcagtggattacaggtgcacaccaccacgcctggctaatttttgtatttttagtagagatggagtttcaccatactggccaggctggtctcaaactcctgacctcatgtgatccacccacctcggcctccca

SEQ ID NO: 401074 - DNA, 386 bp, Homo sapiens
aagtaaatttttcataaataataaaatgataatgactcaggcagttttctggcaagaaaggctactatgatccactccactggatatctgtatattgagcaggttaaaataggcaagaggagtctttgtgattctatttcttggaagtccaagatttagacagaaaaaaatatgagatcattatgtgtaaagaatcttcatttaggaaaggttatatgttggataaaataaaaagaaatatgtttacccaattaaaactggtcttggtttagaaaggctgagatttgaatgcaatgtgttggaatatattaggggtttgggtgtggtgagatggtgatggtggggagatatatttacaaaataaacttcttaagttaatatggatt

SEQ ID NO: 401075 - DNA, 444 bp, Homo sapiens
aaagtcagggtcaggaggcagattagggctacagtgtcatgacaaccaatcaagttgtttgtttcagtccaaaaagtagtcaattcactggaaaatgctcaatcaactaagtgtaaattaaaatagttatgaattgtttgtaaaaagcaaccacagtttgttttaaaaaggtatgaataattttgcatatgcataattttccctaaagatattattctttaaatatgaagcaaaggtcagaatttgagtgtttatatgcaggtgtatttgtgttttaatttcctaagtgggggttaggaggcagattaggactgcaaggggccaaggcaaccaatcaagttgtcattttggtctttgtccttgtctacaaagtagacagttcactggaaaaagttcaagcaattaagtttaaaataaaatatttaccaattcattatgaaaagt

SEQ ID NO: 401076 - DNA, 439 bp, Homo sapiens
agcccagatgattgttagcattttttagcaataaagtatttttaatgaaggtacataccctttttttatacataatgctattatacacttagtagactacaatatagtgtaaacataacttttaaatgcactgggaaatgaaaagattcatgtgatttgctttattgcgataacttgctttactgtggtagtccggaaccaaacccacgatatcttgaagatgtctgtaaatactgtgttctatatcattattattcctttaaacttccacctgcttttatcaccatcttttcatgtgctcttccttagatgacaatggaatttaaattctttgtactttaacctggaaaattttagtagtgtattcatattgtggtcttcgcaccatgtaaaactgactccatattctttttttgtttgtttgtctcattctgtcgcc

SEQ ID NO: 401077 - DNA, 471 bp, Homo sapiens
ccgcccagcctcggtgcgtcgggtaacagccaatggcggcggcctgccagcctcgccccgcccacctcccgccggccccgcccctccacctcgcccccttccgcggccccgccccgcctccccgccctgttcttggcggcctgggctccgcggccctgctggcgtccttcgtctgtagttcctggcttttccaccgtcagccactcgttttaattacgcgaacgggttccaactcatccagcctttaagtttgggtggtggttttgagagggggaaagagatgcaccaaaggaagtaggggaaaaataaaaccttaagcgctgggcgcgccacgcgggacgcagaggttaggggcgcgcggcgaggtagcggggcggcggcgcgagacggcgcaggggaaacactcggtgcctgcgtgagtctggccgcgccggctcatgtgtacgcgaagctgtgtcagcagaaacttta

SEQ ID NO: 401078 - DNA, 415 bp, Homo sapiens
cctgaacgatgagatctgacaccttttgatggcccttgcttgcagtgaatgactccagcttcctttggaagtaaagcggccttgagaagagtttttattaaagaggaattaatgatggaggacccttgcacagtgaggaaacctctttcagcccatataacagcacggtggtgcaggatatggaaggcatatttcgagtcagtatagatattgatgcgtagtccttttgcaagagtgagggctcaggttaaggcatgagttcgccttgctgagaggtagtggagaggggcagagcggtagcctcaatgatagatgtggaagatactatagcatagcctgcctttgttggtgagtggcgattaggcctggtggaactgccatcaataaactgagtgtgatcaggatggggaagagg

SEQ ID NO: 401079 - DNA, 860 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401080 - DNA, 730 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttgtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401081 - DNA, 449 bp, Homo sapiens
caaaaaaggcaaaggaaaacacgctgcattgtagaataaggcattcaaatgtgctgttaacgtttaaggcagctaatgcccaaaacaggcaagtcaagaaaagtggtctggtttggaggtgattttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401082 - DNA, 498 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaatcgcaccaaactatactttcaggatgaatttcttctttctgccatcttttggaataaatattttcctcctttctatggaaatc

SEQ ID NO: 401083 - DNA, 683 bp, Homo sapiens
ggacgcgtgggtcgacccacgcgtccggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401084 - DNA, 657 bp, Homo sapiens
tatccgggagctcgagatatgtggtgactgttcagttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401085 - DNA, 672 bp, Homo sapiens
  misc_feature (1)..(2): n is a, c, g, or t
  misc_feature (10)..(11): n is a, c, g, or t
  misc_feature (24)..(24): n is a, c, g, or t
nngggaaaannaaaaaaaaagaanaaaaagttaggaaagaagaagaaaaaaaaaaaatgctttagttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401086 - DNA, 664 bp, Homo sapiens
  misc_feature (37)..(37): n is a, c, g, or t
  misc_feature (43)..(43): n is a, c, g, or t
acagacgaatatacgaacgcatacacaatcttaaganacaaanaaaaaaaccttttattggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401087 - DNA, 801 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcccccgtgacaccacagaacccagcgggtgccggggcgtctcaagaaacgcctccgccccccactttcgcggctctt

SEQ ID NO: 401088 - DNA, 780 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcgaggtacctcctaccccacgaatccagggggctacccctggctctctgttgccag

SEQ ID NO: 401089 - DNA, 763 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgccacagggagagccttttaacagatcgcgccaaccttca

SEQ ID NO: 401090 - DNA, 179 bp, Homo sapiens
gcgtcctcttactcgtactattcctactgctataagacgacagaaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401091 - DNA, 166 bp, Homo sapiens
tactactatacgggtgcgatttgacgacagaaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401092 - DNA, 1492 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatccaaaaaaaaaaaaaaaaaaaaaaaaaaaaaaaaaaaaaaaaaaaaaaaagggggggggcgcgcaaaaaaaacccccgcggggggccccatgcggcccccggtttttgtgtgcaaagggggcccccaaaggggggcgttattaatacgcgaagccgcgccggcggcccgcgcgagttttaacaacaacgctggcctgatctgggggagcaaccacagccggcactaggctgcggagaccctttggtggagaagaagccccacctcttccggggggggagacacaaattggtgggcgcacccactcactctagaggaagttttacacgccccttagaggaggaaaaattaagcatgtgaacaggggtccatagcggtgggaacccaccaacgcgcgtataatacgtctctggggcttgtagaagaattctggccatccaccgggagactagatgatccttgggaacaaattttttttccccgccgcgcaccttgatgattacaataaaacgtgatagcagtaccacgacgactgacccacgatctgatgagtacactagccagtcatgtaggcctgaccgacactcacgatggctcacaataagtaatcgattctcacaatcgactgaacacgcacgaggcacagcaccactacaggcatacgcagtacgaagtatcaagct

SEQ ID NO: 401093 - DNA, 703 bp, Homo sapiens
  misc_feature (1)..(2): n is a, c, g, or t
  misc_feature (10)..(11): n is a, c, g, or t
  misc_feature (24)..(24): n is a, c, g, or t
nngggaaaannaaaaaaaaagaanaaaaagttaggaaagaagaagaaaaaaaaaaaatgctttagttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatcaaaaaaaatcgttctcactggcctttatgga

SEQ ID NO: 401094 - DNA, 431 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgagcaccaaaagtgccttctaaatgcattgcctcggttacagccatttgtg

SEQ ID NO: 401095 - DNA, 525 bp, Homo sapiens
cttttctatcgctacataatgcctttttaaaaaatgattttgtagtctaaacttaggttgagtatataaaccctgccatgtagcttgagatgcctgaaaagactggtaagtgcgtttcttaatcgttcagtaactatttgagtgcctactgcagccaaggcactggagggatcaaagatgtgtaaatttggagtccctgcaagttcacaagctatttggagagataaggttagtatacatagaactgtaatataaggttgtgttggagcattgtccttaaagatggtaccatggtgagcagttcaaggttacctgccagctgcagaacaaggcagcaaatgctcctgagatggaaccatcacagcctcagacataggactaaagaagtcaagagtgattaaaaagccaggggcaggagacagtaattttgtatttcagtagcaggcatctcgatacactaatttgagagctttattacttttaagaaattaaaaattaaaatgaacctaaattttcaccagctca

SEQ ID NO: 401096 - DNA, 650 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaatactggcccaactaaaccctttttttgggccgttttttatgcttttctttttttttttttttgttgttcccttttaagatatgccttttgggtgcgggacttccggtcttctcttcctaattttcttctctcgtccctctctgccctcccttcccctgcctttcttatcctcttttttctcctttttcactataattgcctcgccctcttttttctccttagttccacccaccgcttatccccctccttctttatctcctatctccacattctttcccatcacctttccttcctcacctctgatacctcctcctctctcgattcctcccccccctactctgcctttctacattcttctacatgctttgtttttttctctgcct

SEQ ID NO: 401097 - DNA, 1540 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatccaaaaaaaaaaaaaaaaaaaaaaaaaaaaaaaaaaaaaaaaaaaaaaaagggggggggcgcgcaaaaaaaacccccgcggggggccccatgcggcccccggtttttgtgtgcaaagggggcccccaaaggggggcgttattaatacgcgaagccgcgccggcggcccgcgcgagttttaacaacaacgctggcctgatctgggggagcaaccacagccggcactaggctgcggagaccctttggtggagaagaagccccacctcttccggggggggagacacaaattggtgggcgcacccactcactctagaggaagttttacacgccccttagaggaggaaaaattaagcatgtgaacaggggtccatagcggtgggaacccaccaacgcgcgtataatacgtctctggggcttgtagaagaattctggccatccaccgggagactagatgatccttgggaacaaattttttttccccgccgcgcaccttgatgattacaataaaacgtgatagcagtaccacgacgactgacccacgatctgatgagtacactagccagtcatgtaggcctgaccgacactcacgatggctcacaataagtaatcgattctcacaatcgactgaacacgcacgaggcacagcaccactacaggcatacgcagtacgaagtatcaagct

SEQ ID NO: 401098 - DNA, 1317 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatcaaaaaacaaaacccaacacacacacccacacacccactgacaacacacagccccccccaacccacacacagcaacaggaaggctaaagaaaaggcataaacacaaagacctcatcggcaccagcgcggcgagcacgccagacggaagagcccgcaatctaccaggtcgacaacacggcagcatcggcacaagcacgcggacccaagtgagcgcacgtgacgtcaagagctatgggacgagctaacagcaacacagaaaaagacataacaagcaacaaacaatcacagtagacacgtagaagagtataaaaccttacagaggaagaataaagataataagagaaacaaaaaaagagatagagcgccgccgggagcaagagacgacaagataaagaaagagacaaacaaagcactagacaccacacaagcgagcaacgcaacaagttagaagataagaa

SEQ ID NO: 401099 - DNA, 1155 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatcgaagataaacacaccaaacaaacctcgagggggggcccggttcccaatttgcctatagggagtcgtttacaatccatgccgtcgtttcacggctgatggcctgcgtacccaataatgcttcagaaatcccttcgcattgggattgaaggcgccaatgcttcaaggtcccttaggatggctgtcctaatgtaacccaatgtacgccttcccggcctgacctatataacaggtgttctgacataggccgcatgggcacctggtacattcgttggtttcgttggttcgtgatctgcgg

SEQ ID NO: 401100 - DNA, 812 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401101 - DNA, 655 bp, Homo sapiens
cccgagaacaagtacagaacataacagaagactaatgcaaacagctagttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401102 - DNA, 905 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatcgaaacttcgccatcggaaacttcgccatcggaaacttcccatcgg

SEQ ID NO: 401103 - DNA, 660 bp, Homo sapiens
acccttcactcactttcttttatcttcctcttctcacacacaaataatttctattggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401104 - DNA, 530 bp, Homo sapiens
actactactaaattcgcggccgcgtcgacgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401105 - DNA, 801 bp, Homo sapiens
gggaaaaatacagactcttgaaactgcggtgaattcattagattccagcacaatcaatctcagtcagcttcattcttcctgctttctgtaacatagagtgttacttgtgctcctcatttcagcagtgtccttggttactggaccttttgccacagccctgcaaaacctggccaaacttgcaccaagttgattatcctgtgtttcatattttgttgagcatctgtgcattttaaagtgttggcttggttaactttctcgatgttaactttttgccttcctgaggaatgtatgaggaccagttaccagaatggttttgttttgcaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401106 - DNA, 514 bp, Homo sapiens
tgatctagaggatgcgtttctctgatcgctctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401107 - DNA, 807 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcactgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401108 - DNA, 812 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401109 - DNA, 312 bp, Homo sapiens
tgcacacgccgagtccccagactgcacacgccgagtctccacacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401110 - DNA, 672 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaatcacattcatgaagtacttgaacgacgcccagtccacaagcatcgaatacgtactgttctaatatagaaggatcccctcttctagagacagacgcaactctgtcatgcagatttatccagta

SEQ ID NO: 401111 - DNA, 1017 bp, Homo sapiens
ggtcgtgttacacgagacccacgtctgcctggcgtggatccctggcccacgagttcttacccctaccctgagaggaggaccgggctccactacctctatgtggacaggattgaggctcagagccagggttatgcattgggccccaatggaccagcttaggcgggccaggcagacttggagctcaaggtccactggtaacacagacagcggccaccctactcccccaccacacctggccccactagaggcctcctccccaaagtccagccccagcaaggcctgccggccgactgtcatctcagcactgagatgacagtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatc

SEQ ID NO: 401112 - DNA, 909 bp, Homo sapiens
  misc_feature (862)..(862): n is a, c, g, or t
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatcanaaataaaaagaaaagataaaattataaaatatatttaaccactacgg

SEQ ID NO: 401113 - DNA, 891 bp, Homo sapiens
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatcaaaaaaaatcgttctcactggcctttatgga

SEQ ID NO: 401114 - DNA, 1316 bp, Homo sapiens
  misc_feature (1167)..(1167): n is a, c, g, or t
aggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaggggtggtcagtaggagagcacgttcagagggaagagccatctcaacagaatcgcaccaaactatactttcaggatgaatttcttctttctgccatcttttggaataaatattttcctcctttctatggaaatctctaaaaaaaaaaacaaaaacaaatatggcttatttggccatatgccctatatggggggatacaaatactggccgccgtttcacacagcggtctggagaaacctggggtacccactttaagcctttggggaaacacctctttacacatgggcggaaaacaaagaggcccccggatgggctttcaaacattgggctcttcttagtctatgcaaattagcgcgcatatttgtaatatcgctaaatatgtaaaacgccttttttcccatgcgcgatgggagaacctctaatataaagaaaatcgcccatnacgtgggggtctcctttcaacacactctttagacaggttctcctccgtgggcccttttttgggggccctcgcgcacacccccacaactttttggggggccactttcctgaagggccccattattttcactcgggaagagccctgcgggc

SEQ ID NO: 401115 - DNA, 1624 bp, Homo sapiens
atgaactatatcttaagaattcataaagccctaaaaagtaaatatttacaaccagaaatctttctgacaaagaaacaagattactcaaagtaagtagtagtttgggctccctggaaagaacccagaacttaagtgtcaggaaatgtggatagttctgaatgtgcccctggctggttgatgactctgggcaacttatgcagtacctctaactcatggtttatttacctgaaaaataagtgggttggctatgtctgtggtttgaaaggtgctctatgatgtcccagatgtcttagcagtgtatcattggctgttttggaggctgtcaggggtccagatggctgctcccactgagcctgcttttaacagagcttttcagtttgtatttcttgtatacacaaagtaatattaaataaaaaaaatataatccagctaagaaagtttgagaatactggcttgagattcaaaataaaataaaccaaaaattttagaaattatattagtctagaaagatagtattgtgtctctttgtctttttagtacctagcacatatcaggtacttgatacatatttatcatatgaatgcaatggttgtaatgaacaactgggaaggaaatgcaaaagcagaaggcaccatatttgtgttgctattcctgggtgtcatttctatgtaacttgtgataaccagtagtaaagaacaacatggactatgtttaatagacaacaactaattttattggatttgtgtacataatctgaaatttagtctaaggacaagccatattactataaattccaggaaatctagagagaaaaaatgggcaatttagaacagactagaagagtaactctttcagtttgtctggaaaaccgaatctaaggaataaggtcagtttgcagtttctttcaagtagaattggtgactcttggatgcagtttataaacacgtaacacattttccttgcatggaaatatatctattctatgacctcttctacatgaagaaaagatttgaaattttcttctccattaaataatgttttgtgtgcatgttgcaaaaataagagagaagcaagaataactctagcagatgcttaaaggtttaagattaaagacacatgtaaatgtgattcatagtgggtgttctgtgcacttgagtgaatattcccaaatcacagctagaaaaatttaggagtaaattgacttaacttatggtaaatcaataggggtccctgaattggagggaaacagatgagcaagaaaaaaattatttgacaggactccactaaggaaaacaacattcaagtaacagatgaggtattctactgcccagaggaattacccagcctttagcaaggcgaagtcagcctcaactggcaggaggtttgttttaaaactgaaatgagaaaaaggatctgggcttacaaatgatgggaagatatattatcaacagggaaaaaaacccccagaaaatagcaactaacttgtttccccagcacaactgaaaggatgaagaaggaaaacaatttaatgtaccctggtcatgcagttactttcctttatccttactaacagtgcttgtcaagatggttctggaaactgaataaatgtaagtaatgaatcatg

SEQ ID NO: 401116 - DNA, 444 bp, Homo sapiens
tcctcggaaaagcaaactctaaacaatcacctttccttccttcctaactaggaaacatcttattccctctgcagctatatgttatttcttctctaaggaaagcagttattgtttcttgttctcagacctaaagtggagaaaactagagacagaactttggatcctatcatttctcagaagccatgagtcagagaaggaagaaccaacaaagggctctgaactatagactgaattctatatgcacatttatacatagcccagttctagttgtctctagagatttcttatgtagaaatatctatacaagacaacagctaactgtagagctcatcaaaatcagggattgtacctttcatttcttatataaccatggttgtacctggtaagatattaatgttacaacaggtaatgaataaaattttggtttattaattgaatcacttt

SEQ ID NO: 401117 - DNA, 354 bp, Homo sapiens
gctcaggtagggacctgttccccaccaagtctatgtaagagagtccctcaggtgccttcaggccagccctaaaggtggctcaaccagcttctccattcaggactggttgacatctattatgggctaaaaattgtgcccctctcccccaaaattcataatgttgaattcctaacccccagaaactcaggatgcgactacagtcatttctcaacatagctgggggattggttccagaaccccctcatatagccaaatccacacatactcaaatcccacgtcatattccaaaagcctgccctccatatatgagggtttcacatcccacaaatactgtattttcaatagcgtttgata

SEQ ID NO: 401118 - DNA, 489 bp, Homo sapiens
acagagtaggacagctttgtgacatttctcaggctatttcccctgacctctcatcaatgctgacgtttttgataagaaggggtatagagactgcagcccttggggtggttacagttcatttatttacaggccttatattgacaggcctcagatttcatgctcagtaccataaaggttgatttttaaccaccaagaggcaaaagaaacatgacaggtcggagcatattttctcacctattctggcttaaatgatggtacttacctgatttgtggttgtaggtgaaatgttgggtgaaagattagctgctataaaaaggatgtcaggacgtgtagagaatttagaggacttgggtgggagatggatgtctattttctaaccccttagtcatgttcattccgatgccagcataaactctattttgagatgattatagaaataacttatatcttcatttgtttgtgggaaataaaaaataaaaatgatataaa

SEQ ID NO: 401119 - DNA, 405 bp, Homo sapiens
ctaacatgtaatcactaatctttaggagcttccaatctattggggagagtgataatagacgtataatgcacccacaaagagctataacataaggtagaatgtgatctgagcactaaggaaatttaaaaggggtgttgtgatcactagttctggccaaaataatgtaagggacagtttttttctctctctctctctcattttttttttaaagggacgggagtaggaattacacttgagcctctattccactatctgcagtattttctccaacttgagtccctgatggtcagttcttcattactaccacctggttcagtgtttagaaccatgtgacacacataatgattattcagtagaagaaaaactgagaaagtgaagcctgggatatatgggggaaagcctgac

SEQ ID NO: 401120 - DNA, 508 bp, Homo sapiens
acctcagttttcccatctgtgaaatggaggcagggccggcaggcatgttgcagctacttcccaccattgcaatagaaatagcacggacctgacaaacatcgtgcgctgggcactgtgttaagtgttttgcacgcatgagcgctggttctctgccctggctgtccctggaaccgcctgaggtgctttagaaagcatcagtgtctcagccgggcgtggtggcttatgcctataatgccagcacttttggaggctgaggcagacagatcacctgaagtcaggagttcaagaccagcctggccaatatgtgaaaccctgtctctactaaaaatacaaaaattagcccggcatggtggtgcgtgcctgtaatcccagctacccaggaggctgaggcaggagaatcgttggaacccaggaggcagaggttgcagtgaatggagatcgcgccactgcactctagcctgggtgaccagcctgggtgacagagtgagactccgtctcaaaaaaaaaa

SEQ ID NO: 401121 - DNA, 757 bp, Homo sapiens
gttcacggcgtgtaagtaacggagcagagaccgggacgctggtctttggatgttaagtgcaagtggttccattgcccttcagcactggggagagagttgggggccgttttcttcttctaagtgatattttggaaccaacacagtactgccccattgccttccccacagccatttctttattacattatttttttcctgctgcttccaacccattctcttctgcacaaaacccccagtttcgctctcccaggctttcacacacattactcaatccacccgaaaagtactctgtactgcttcactcaaactccgacacccagcaagcctttgtcagggcaggaagatgcaaagtgcccctattgcacggttaggctggggctctaatattggccactggtctgcactgggatctcaggcaagtcacgtactgcctctcagcctctaagtgcccttccaattatagtctgccatcccatcaatcagtggatgcaatcctttttaatgagttatccagctaactctcaatgcgtctagataatagaatgctgcaatcttaataaaatgcttctctcctggagaaggctgtttaatggctagaacagtggtggcgaattcaggatcggcggaaggtttgagtgccagtctcctccaatgttagaaatcagtcttggggactccagggactgtgctgctctggcctgatgcctttgcagccctgggtggacctgccctcctctatgggcctcactgtctcccc

SEQ ID NO: 401122 - DNA, 741 bp, Homo sapiens
tgcgaacggactgatcttctggggccatgcgccgaactcgcagacccgcggtctcgagatgaagaaggcgatggacaagctggacctgctggtcgtcatcgatcagtccgttcgcatgttaacatgcgaacggactgatcattgattttttaaaagtgttgtatggaataagtttaaaaacagtgaagaaatggtgacaatttttgtggaattcattggtgccccttaaagaagatcaacacatctttgacgattgtaaaaccagaactgtgaattactttcctaaacaatcctaaacttttagccatcatatgtgtgtgtttaaatgcaatccttgatactatacagacatggaattttagatcagtccgttcgcatgaacatgcgaacggactgatctgggggacgacagggctcagcagtttgttcatcagctccagtaccttgtcagcattctgctcaagtttttaaaattaaggaagcaatcaataaagtaatcaataaaaggaacaactatataatgccccctacccaccaaagagaactttctggggtgacattttttaccgcctcccaagttcaagcaattctcgtgcctcagcctctggaatagctgggactacaggtatgcgtcaccacgcccggctaatttttgtatttttcagtagagatgggatttcaccatgttggccaggctggtctcgaactcctgaactcaggtgatcagtccgttcgcatgtt

SEQ ID NO: 401123 - DNA, 619 bp, Homo sapiens
gactgtcacgacggaccatcgcatctttaaacagtgtcgtatctaataaaatcctgaacggtgaagaaatggtgacaatttttgtggaattcattggtgccccttaaagaagatcaacacatctttgacgattgtaaaaccagaactgtgaattactttcctaaacaatcctaaacttttagccatcatatgtgtgtgtttaaatgcaatccttgatactatacagacatggaattttagatcagtccgttcgcatgaacatgcgaacggactgatctgggggacgacagggctcagcagtttgttcatcagctccagtaccttgtcagcattctgctcaagtttttaaaattaaggaagcaatcaataaagtaatcaataaaaggaacaactatataatgccccctacccaccaaagagaactttctggggtgacattttttaccgcctcccaagttcaagcaattctcgtgcctcagcctctggaatagctgggactacaggtatgcgtcaccacgcccggctaatttttgtatttttcagtagagatgggatttcaccatgttggccaggctggtctcgaactcctgaactcaggtgatcagtccgttcgcatgtt

SEQ ID NO: 401124 - DNA, 258 bp, Homo sapiens
ctgaactcaagccatctgcccaccttggcctctcaaactgctgggattataggtgcgagccattgcgcccggcctgatcattgattttttaaaagtgttgtatggaataagtttaaaaacagtgaagaaatggtgacaatttttgtggaattcattggtgccccttaaagaagatcaacacatctttgacgattgtaaaaccagaactgtgaattactttcctaaacaatcctaaacttttagccatcatatgtgtgt

SEQ ID NO: 401125 - DNA, 689 bp, Homo sapiens
gtgtattttaaaaaaaaatagatggtaatggttatctgataccacttttgaaagaatggcatcacagttttattttgtaaatgtcagtatttataacaatttcaaaattatatattttgcaagtatttaaatttattattaaaaattacatctcaatttaaacattttcaagtgactgcgtaattttccaaaattattttatggagtacatgtgtaaaaagcttagatgcccaacagtatgctgaaagtggagttgttatgtaggagggtgtgtatatccttacctagattttttgccaaattttaagtggttgccttactttgcactcccacaacagtatatgggaattctcttatttccgtattttctcaaacattttgtattgtcaacttttaggtttttgcgtgtccaaagagtgtaaaatgctatcgctttgtgtttttaagtttgcactcccctgattgctagtgagttcctcttctgtgaactgcctgctcatatcttcacccatttttcaattgattaatgtacatatttgtaatgtaaggaactagtttttataggatgttggcctttgcagcttattttggggaaaacacctttaaatttcttttactcttctaattctcaatctagtccttagccaaaaatattccccttaacacaacattcttatttttgatctgct

SEQ ID NO: 401126 - DNA, 461 bp, Homo sapiens
gcggtggccaagaggcctcctgtgccccccaagaggcaagagaacccagggcaccccggcggagcaggaggcggggagcaagatttcatgtcagacctcatgaaagctttgcaaaagaagagaggcaacgtgtcctagggacgggcatgatgagtgttccagagggagaagcatcgctgaccccgagcgcaggttttgctagcagattgccctgacatcttgttcatttcagataaaatgtgatgggaaacttctcactgatgtgctcaagtacaggcataaccattaacccagtagagttcagaatatctgcccaaatgtacatatcgttcccatgtattttaacctaaatggaatgtatcttcccttccaagctgcctaaagcgctgttttaggttcatttattttattatgttcagaagcatcaaataaaagttaaacgtttttccggaaaacggtat

SEQ ID NO: 401127 - DNA, 315 bp, Homo sapiens
cggtatagaaagtcatagaatgggtgaagagttaggagaattgaatgtaaatggatggaatataaaacccagggaggtagatgtattctcaccagtggaaataccaggacaacatttggggatctctcagtagtggacatggtattaatttcctattgtgctacaacaaatttccacaagcttagtgccttaaaacaatgcaaatgtattatctaacacaagggtgtccaaacttttggcttccctgggccacatgggaagaattgtcataaaatacactaaaactagtgaaagctgatgagctttaaaaaaaaa

SEQ ID NO: 401128 - DNA, 423 bp, Homo sapiens
aatcacaggagctcttaaaagcagagaattttctctgcttgcattagaccccaagatggaggaaaaggagaagtcagagaggctctaagtgtgacagactcaaccaccttggctggagtgaagccacctggaaagcaagagaaggcataaaggcaatctttagggagaaaagaccagcctctgaatgacaggagagagaaaaaaaataggaaactcattctgataaccactaggaattgaactgccaacaagttgaatgaatttggaagtgaattcttttctatagccttgaataaggaacgcagccctatcaacaccttctttccagtcttatcagaccctaagcaaaacacccagctgaacccgctcagacttctgacctacataaattgtaagatattaagtttgtgttgtttcaaactg

SEQ ID NO: 401129 - DNA, 418 bp, Homo sapiens
tagggcctaggggatcagctggcataggaagggtgtccagatgggcaatgggccatccacagagaggggcgggggctacacagctatccacgcccagccgtcagggaatgagctgggggggtggcaccaggcagcagccttgtgcagcagccttgtgcaaaagccctggggccttggttgacctcagcgtcgtggcacagctgcctgacaagtagatggggacatgggctgctttaatagaggcagagtgccccatctggggagggagccgcgggtccctgcagactgtgtaggctgcttgctgagctttagacatcagtccttgctccagtgaatgaaagctgaggcctccacctgagcagccctgcctgccccgtgcactttgggcatcgggagtctcagtgaggttgctttagga

SEQ ID NO: 401130 - DNA, 356 bp, Homo sapiens
cacgaggacacctgctttgaaaggatgccatgttcatcaccctcatccttgcccttcacccgttcagcgtaaaggaagatatagaatctctttccagattgattgattgaaaccaaatagatcaacactctcccagcaccttttagattttccttgtcaacagaagaccccagggccatcccatgtccatcacagtgaaggtgatggaagcctcaccgtttatcccggtcctggggtcatcacagaagcaccctagtcagccacacataatgtataatggatcatttcccaagctccctcaaatgctaggaagacattttgagaagtagtggggtagagtagcagtttcatccacc

SEQ ID NO: 401131 - DNA, 493 bp, Homo sapiens
tgagctcagaccttggcgattccagagtgtctgaggcccagagccagccccgccagcacggccagacgaaaggaaaggggggaggtggcagggtgggcaccaggaagccattccgagggggctggcagggaagctgggttctagctttgttctttctgctcctcttctggaccccacagacttcctcctgggacctccgtgagccctggccaaaggctgtccccaccctttagccctttcctcagaggggattggaccagcactaacgagaagttactttggggccctgagacccccacgtttgcaagggaggctgggaaagagctggaaggcctgggctccggctccacccggcctccatcgtcagtgtgacccggcagggccacctctctccctcagcctcggtatctcgctctacgcaggcctccccgccccgccccgcccggaggaatccgcggccggccagacggtcccaggtgagggccctctggaa

SEQ ID NO: 401132 - DNA, 455 bp, Homo sapiens
aggtgggtggatcacctgaggttgggagttggagaccagcctgaccaacatggagaaaccccatctctactaaaaatacaaaattactgaggcgtggtggtgcatgcctataatctcagctgaggcaggagaattgcttgtacccaggaggtggaggttgcggtgagccgaaatgacgccactggactccggcctgggcaacaagagtggaacaacgtctcaaaaaaataaaaataaaaaacaaaaaaaactgttttgtctcccagcaagagaaaagagactgcccatggctgtgaggcacattcccttgtgggaaagctcttaacataactggcaaatgagttggatgctggcagccctggggttctacatctaggtcttgacaggaatagacactgtctctggactgggctttgtttgcatggtagaagatgcaaacactcagagtgccacta

SEQ ID NO: 401133 - DNA, 517 bp, Homo sapiens
ataaaatgtctgagcatctatgttcatagaaatcatgaccttcacatctttgaggagtgtcagtgaaactatgaatatgatggtataatatttatactgcagcagctctcatatcagccaccttttacattgtcttcacaagcaggtttttgtttggtactttaaatcacaggcgatggaatggggcagtgtaatatgccttaagtctattgtttatgaaattatgtcctcagagttaaaatatgtagaaagtagttgacagcattctgtcatctctcccatgcactgcttttgctgtggatgaaaatgaataagcaactctggaaaccaaggtcctctgggaacataaaaactcctgtggctattaatggatttaattgtatttcctctctgccaccaagatatgcaataaattgtttatgcccttgccgttagtggggagaattgttcattaaacgcatgtaatgtcattattgctttgtttttattacttgtaggtagtcctatctctcctttt

SEQ ID NO: 401134 - DNA, 425 bp, Homo sapiens
tttgtggcaaggcaagtaggcacacataatttgtctttcttcctcattcttgagagcatcacacttgtctaccttatcgcttctactctttcttttttaacttttgacccacttgtacatgaacttgtaccctaatgtccattctcctatctaatcttcatatctctgggccccagatctcatccatttacatacgtcaccatctacagtgttctctccagtgttggcatagagatttgtgttagcgaatatatatactttgttaaactctcctcgagtagctgctgtgttgtgcttgtgttttccttggccttgccatatgcaattgcatatggcaaggccaaggagttgtgtaaggcagcagacatggtgcagtagaaaaagctacctatggaggtgcccctacttggccttgccatatgcaa

SEQ ID NO: 401135 - DNA, 463 bp, Homo sapiens
tttgtggcaaggcaagtaggcacacataatttgtctttcttcctcattcttgagagcatcacacttgtctaccttatcgcttctactctttcttttttaacttttgacccacttgtacatgaacttgtaccctaatgtccattctcctatctaatcttcatatctctgggccccagatctcatccatttacatacgtcaccatctacagtgttctctccagtgttggcatagagatttgtgttagcgaatatatatactttgttaaactctcctcgagtagctgctgtgttgtgcttgtgttttccttggcctggacaaatccctctctacagcactcacatgtcatgaggacataaattctgcagatgagtggtttgcagatgcagggattgtagaccctgcctgtactccctgttttacatacatggttgtgtcctttaacttatgaggcctcctacattc

SEQ ID NO: 401136 - DNA, 473 bp, Homo sapiens
aaaagtagctagaaactggaaaggttttcatccttggatgaagggcaccgcataggataaactccacatttaaatggcttttccctcaagacattccctggtctgcagggagcaggacagatagaactctagcaggaaatcacagtcttattggcctgagagtgagtttgaggctgccggaggacctggacattgagtgggataagcctttgtgtgaacaaggtgaaccaccaataatttatttaccttttattaaaaaactacatactcttaagaggaggagaacaaatccaaactctctacagcttatcatccaaaatgtctaatacaccataaaaattactaagcaacctgggtgtggtggcatgttcccattgttccagctactcaggaggctgaggtgcgaagatggcttgagcctaggagttcaagacctgcctggacaatataaaaataccttgtcttattaaaaa

SEQ ID NO: 401137 - DNA, 190 bp, Homo sapiens
gtgtgacttttcagcaagaaatctgcttctaaaattctcactatttgtgagggttggagggtaagtaaccagatctgtttgaaattagcttatgtgcttgcattaaggcttttgtaaatattttatgccatttaagttcacagtagaaatggcctaagtatctttttagtagattttagtagaagagtaa

SEQ ID NO: 401138 - DNA, 351 bp, Homo sapiens
gaacacaataccccaaattacagcactttggcaaactgagcatttgaagctgaaggaatttgaggaaaccatagaagcaggaaggtcactctctgaccttctcctgccttcctcttctgcagtgggccactcaaggtttctctgacctgcctctcctgaaagtaggccccaagcccctcattccagagggggtccggtcctgtccgtggagaccatgaagactaaactcacaggccttgctaagttcccactgtgtacatcattggatcaaacccttttgtcctcctgtgacactgctgcttgactgtccataaaaacacaggtgccctgggtcacggttcttcactttgg

SEQ ID NO: 401139 - DNA, 708 bp, Homo sapiens
aaggaatagatgaagagagaacatgaagggaaaaaatgacaagatttggagtccggctctataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaatggagctgtagatgaagtcgtccaccatctgaaatggcaagcagagtaagatacttatgaacattacagtggcattatggaatggcccca

SEQ ID NO: 401140 - DNA, 467 bp, Homo sapiens
  misc_feature (380)..(380): n is a, c, g, or t
  misc_feature (433)..(433): n is a, c, g, or t
  misc_feature (455)..(455): n is a, c, g, or t
taaccccatcgtgagtcaaggagcatctgtaaaatgtgtaaatctattcactgtaagattacttaagttttaaaatcctgaggtacaatatttcataaataaaaattttgtatttcatagaatgacataagcatattcagaaccaggcaaagattaggctatatactgtgatttctgaaaattactattttgtccactatacataatcatttataagttgaataatttctaaaatgcatatgctttatacttttcagtgaagtatttataaagatatttgttttaatatgtacttctttttataggactggaaggaaaagtatataaaccgtgattattcaaagattttcactgaaaatatagttgaacagccctgccanaaggcttttgggcataccgcaaaatgggctggggggaaaaccatcatggaagnccgatctggggggtatttgtcnctggatgatttc

SEQ ID NO: 401141 - DNA, 3753 bp, Homo sapiens
agcgggctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 401142 - DNA, 2666 bp, Homo sapiens
atagcagcggcggtgccccgtgtttccgtgatggtcgatctctagagctatccccgttgaacagcacagcccactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 401143 - DNA, 4335 bp, Homo sapiens
agcgggctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaagttttgtgttctattattggtgtttatcttccaacgtgaatacatgatggaattgtctgaaaaacacaaaaacaaaaacacacaaaaaaaaaaaaaaaaaaccacaacacaaaaacacaaaagaacaacacaaaaaaaaaaaaaaaacaaggggggggggcacaaaaaagacccaccgagaagacacaaacataagacaccaacatagtaaaacaacacgaccaaaagagagaaaataaaaacagcaaaaaaggagcaaataaaaaacggagaaggacaacacctcccaatacaacgaagagacaccccaacaagggggcgcacatgcagccgcacacctccaccacgaaaacacgcacgcagatcaaccaaaagggagtgacggggccaaccacacacccttactcgcggacgaaacacgccgcgcggatttaaaatacgaacaagacacacaacaatatcgataacaaccgtagcgaccgacagtgcactgacaccggccgaatcgacgcggacgccaaactccacacacaccacaagcacgcagcaaccaccgaacgacaccacacacatgcaccagca

SEQ ID NO: 401144 - DNA, 1948 bp, Homo sapiens
  misc_feature (27)..(27): n is a, c, g, or t
ggacgcgtgggtcgacccacgcgtcgnccacgcgtccgcaatgacctctggcagattttggaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 401145 - DNA, 1841 bp, Homo sapiens
  misc_feature (87)..(87): n is a, c, g, or t
ggggtgactagcaggacctacgtgacacttcagttacactgaaggtcttgcaggctattatacgaagggatttgcactactgaattntgtagtaaaatactcccctgaacgacagcgttctcttcgtcctcatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 401146 - DNA, 3664 bp, Homo sapiens
agcgggctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgcaggtaatccgtgagggccctcacggattacctcaattaaaacatttttttaaagaaaacaatgatttccaagatatactattaaggggataaagtaagacacagaggaatactaatatctgtgttagaaagagagggaaagagagagaggtatttatacatcagatacctggaaaggtcccaggaatctgaacatagtaattacctctagaaagagaaactgggtgccctttgaattttgtagcttatgaataaatcaatattcattaatctaaagattccaataacacacagtggttcgtactcaggtcagcacaagattatcaa

SEQ ID NO: 401147 - DNA, 1178 bp, Homo sapiens
gcacgagaaaacacagattgaaggctcagagcaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 401148 - DNA, 916 bp, Homo sapiens
  misc_feature (27)..(27): n is a, c, g, or t
ggacgcgtgggtcgacccacgcgtcgngaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 401149 - DNA, 1471 bp, Homo sapiens
agcgggctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgaccgtgccaacggacttgccgccggtggtgtgtactcccccgccagagctttgctccctgcgtgtactgcgtcccggaag

SEQ ID NO: 401150 - DNA, 3690 bp, Homo sapiens
agcgggctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 401151 - DNA, 2614 bp, Homo sapiens
tcccctgtgaagcacaccccactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaa

SEQ ID NO: 401152 - DNA, 3984 bp, Homo sapiens
agcgggctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaaaacaaaacaacaaaaaaaacaaaaaaaaatttgtggggggctcgactggaaaagtttttaaaacattcgttggggcgggcgccatggttattgacttggtcatagtgtccaggaaatcggccagaactcggtgcggtttctcaccattaaaaagccggcgaccgggtttgacaatccatggggtcgagcctaagggtttaaaggggtcaaggatcttccccgtggagggtt

SEQ ID NO: 401153 - DNA, 3793 bp, Homo sapiens
agcgggctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgtcgggtgtcattttctttctaacatgtgtcaccagttgtgattcgctgggggcgatttattgggtggagaaaagtgggtgctaagagctgtcgcggccgccc

SEQ ID NO: 401154 - DNA, 3611 bp, Homo sapiens
agcgggctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacattttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttaatataatccactttggaagattcatctgaaagaaacatagggtttgattgtcgac

SEQ ID NO: 401155 - DNA, 1785 bp, Homo sapiens
agcgggctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctccgccgggatgttacaagtaagaatgtatcataagagggaaaagacctctccctacgtccgaaagcattccaattgactcagcccggacaacgggtgtgcttaaacc

SEQ ID NO: 401156 - DNA, 234 bp, Homo sapiens
ccataggttttgatataaaaagtcttacttttattaatttttaagataatacatttttagtttttgtatcttttttcatataggggttgtttctttaaagtttatctgattttcaagtgattaagttttgcaagggataatcttttagttgctgagtctctgttttattataattggagaatataattcataactctctgcatttggggagattaataaagtagttttatttct

SEQ ID NO: 401157 - DNA, 645 bp, Homo sapiens
tctctccattgatggaaagctataggatcttatttctttaaaaaattctgtaatttggccaggcgcagtggctcacgcctgtaatcccagcactttgggaggccgaggcgggtggatcacctgaggttgggagttcgagactagcctgaccaacatggagaaaccccctctctactaaaaatacaaaattagcctggcgtggtagcacatgcctgtaatcccagctactcgggaggctgaggcaggagagtcgcttgaacccgggaggcagaggttgcggtgaacggagattgtgccattgcactccagcctgggcaacaagagtgaaattctgtctcgataatcaatggagcacttaaaaggcaggttgggctgggcacggtggctcacgcccgtaatcccagcactttggaaggcggaggtgggaggattgcttgaacccagcagttcgaaaccagcctgggccacatagccaggccccatctctacagaaaattacctgggcggtggtgtagccccagctactcgggaggctgacttggggggatggcttgagccccggaagtcgaggctacagtaggacgtgttcccgccactgcactccaggcccgccttccggcgctcagatgagcacagggttcgcag

SEQ ID NO: 401158 - DNA, 415 bp, Homo sapiens
taggagaaaaggtcctctttctgggcgaggaagtcaataaagtaaaggacgcttcataaagtccttcgggaagcaaaacttgcttaacttcacacttccttgaacccccacgcagggaatgcttcctccgggacccggagcaggcaggctgctgtgcctggcaggccggctcctgggtgcaaggctcccgcgcagcccaggacagcagcgcgcgggctacgggcgagtggagttgcaggggcccgggcggagagccgctgtcacccagggaagctctcgggactccgggcctcccgcgaagctccggacgggcgtcaccgaagccgagagtcccggccgagcccctccgcacggtgggcgccgcgcccaggcgagcgcgcgaggtcgggcggggccgggggccgcccggggaggg

SEQ ID NO: 401159 - DNA, 420 bp, Homo sapiens
cctttataagtgttgaagttgggtagtataatttctacaattttgttctttttgaaaatcgtttccaaaccccgtttaattataacacttaaaattttatttccatttgctattataagtccctataatttggctcttgttttcttatttatttatatcttgagtatatttacatggaggtatgtgattatgtgtatgtaggcatttagatatatgaatgtgattatgtctgttctctgagtttctttgtacaaaaagtagaataaatatctatgccctaaaatatcgactagcaaaacaggctgggtaggattaaaatatgtgagtgtcatcccttctcatcaatattcttaaagtatttgttccacatgtatttctctttatattcaaaatgaggaatttgtgatatgtactaaaagc

SEQ ID NO: 401160 - DNA, 624 bp, Homo sapiens
tgcatagtcacaaaaatgtggtgttcagattgagctaacaaaaaggaagtcaggccccagcaaagacagacaagctagaagttagtctttctctctgtatgaaacattaagtctttaccatatcttttctgtccattctttttagacagtgtgcctcggcccatttttgttaaattccctaaaatccaatgtgtctctattaatactgcatagatataatatgaaattatcctccagctccaaaatacaaattcaaaaactatataagaaaattcagataaaactttcaaggtagagtttactttttcaacagaagagcaaaattaatttaagtgtaaatgtacaacaaagtcgagctaatagaaggatggtgaagtaaattttggtattttcgttcttcagatactacagaatttccaaggacttgaggaataattgcactcttgaaagagcctatgaaaaaagaagagacttgggaaatttaacagaagttcactttccaccactgcgcaaactaaggaaaaacttaaagcagtaaatagctgcggttggcaaagctgttttggctcaggagcagctatcaggccttgataaggtccacaagtctgctgttctaaaatcaaa

SEQ ID NO: 401161 - DNA, 284 bp, Homo sapiens
gaattagttatatattttttaataatatattgttttttaatggatgagagagggagatcttaatactacagaatttccaaggacttgaggaataattgcactcttgaaagagcctatgaaaaaagaagagacttgggaaatttaacagaagttcactttccaccactgcgcaaactaaggaaaaacttaaagcagtaaatagctgcggttggcaaagctgttttggctcaggagcagctatcaggccttgataaggtccacaagtctgctgttctaaaatcaaa

SEQ ID NO: 401162 - DNA, 817 bp, Homo sapiens
tcttgtgtatacttgggatgtttctaaccacatttgcctcagttacctaatattttttgcttttcaattgatttctagtttggggatgaagaagaaaaagaatgtaactggcaaaatagccattattttttgcctttattcttatttcacactttctatttttagtttatcttgctttgtaaccaatcctttagaatgtaattacttcttaattggaaggggctaactgccccacagaagaaacttctgtaattagaaaaagagtcccataacatctgatctggttctttcgccctgagcatatttgttggcaatttatggcaaggttgactcactggtgggaagctgcctcactcctaacctgtgctagaaaagctgcctcgttctagaggcagccctgcccctgttaagcccagttctgctgcctcactcctaacctgtgctagaaaagctggctctttctagaggcagtcctgccccctgttaagcccagttctgctgcctcactcctaacctgtgctagaaaagctggctctttctagaggcagccctgccccgttaagcccagttccctctgccctggcatctccacctctactggggcagtttccccagttctcttcccagccagcagcacccctggagccttccttttagtctccggtcacatgagtgaagaggaaattttcctccttctccgagcttaatacagcagttttatatatttaacattgtaggtgatttgcatggcaatgagcttattaggctgttttttgagtgctgccaaacacctaattgattttttcagttttcttcc

SEQ ID NO: 401163 - DNA, 473 bp, Homo sapiens
actccaggtgcctcctgccagaacagatgccagcgtggaggaggtgctttgttaaatggcacttcaatcagccctggggagaacgggttacagagcctcacatccagcctcgacgattcaacagcccgggagggcaaaggtattcaccggggagggcgaaggcttcctctcccaggacagacccgcgcttgggctgcggcctccgtctttattttgaagccctacagggctcgtctctgcagcaggctcagaatgagctattttcgcccacagccaaaatcagcaacagcaaattacactgcaaacaatggcgagggcgcctgctcggctcggctcgaaactccggagaggcagcgcaaagattctgacttttcacttgggcagagcccgtccgccgcctccccgcgctccggctgcgcaccgcgctcgggttccggccacacgccccgaggacagggagacagggcggccgc

SEQ ID NO: 401164 - DNA, 370 bp, Homo sapiens
tctatcagtttttccttcacattttttgaccctctgttgttaggtgcaaacagcttaaggatttctatgtcctgttggaaaactgatccctttatgatcatgtaactcccttctttatccctgataattttttttctttctatgaagtcagtttcgtctgaaattattatgaggattttttttttagacagagccttgctctgtcacccaggctggagtgcagtggcaatcatagtaaaattgacccaactgtccatagaactgatgtttacttttttttggataaacaaagaaattgaccctcccaggtcgggtgcagtggctcacatctgcatcccagcacttttggaggctgaggtgggtggatcac

SEQ ID NO: 401165 - DNA, 164 bp, Homo sapiens
ggtgaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggta

SEQ ID NO: 401166 - DNA, 498 bp, Homo sapiens
ctaggtgggaagctccttgcaggcaggaaccccatctccttgactttactttggaatccccgcagcctcatacggggctgaggcaggtccttccgtaaaatggaactgaatgagcggcgcttaatccatccgccaaaggccagtctcccttgggttttcaacagctggagaaatatcaaaagaatctgaatatcaccatctggaagttgtgccatggactccagtgggcaggattcgagctgggattctcttcttcctctagcagtgtatttcttctgcttaaaatgagcacaaacacatctaattccctaatggaccaactcagacctaaaagtctcttattctttgcccgccttcctctacccacatggattcctgggattctctaaatgcagatggcaatggggagggctggggattcccatcaaggatatttgatcatcggtgacttcacttaaccaataaatcaaacgtgttgaaatacacacatgtcagaaa

SEQ ID NO: 401167 - DNA, 447 bp, Homo sapiens
aagaagctcagcaggaggggactgaggagtgggcgagtcagccgctgaatgtgtgcagcactgagcatgggcgaggctgcttgggagaccctgcaagggtttgggggacccttgtgaggactgaccaggaccgcctgtgctctgctcagggcatgtgttgtaaacacgggagactcaggccttgacccagggaacatgggactcagatgcaaattcagtagtcctcgaatttcagtgaaatcggcgttacttagagaactgctcaaaatacagcagaccaagaatttcacttctgaaaggtgaaaagaagtaggtgcactggcttgggacctcggaacccaagaaacaagatggtggtgaattgcctgggttttcttttgccttataaattccagacttggagctaaacaagccagcaacccagaaacaccaatgaacacagatgga

SEQ ID NO: 401168 - DNA, 399 bp, Homo sapiens
tgatattctatgcagagaatgtatcaaatataattaagaacaaagagatttgtatttgcattttccatctacaaaaccactacatacctcctctcacctggtggttcaagcccatatatatgccatcctcctcatttggggcatccagaagcctccagacttgctgaggatagtgttacagcttgcattttgatcagaacaggaatgaaaagtgacttgaagaagaattgcatttacaacatgcaccatttttgtcattttggaaacatgctgcattttctgattgcagacattttcacatcctaatataggacctgtcagtccccagcacaaattaaacaagggtgaaaggagtctgcaatggctctcttgtcaagacagagggtttggggcactacc

SEQ ID NO: 401169 - DNA, 577 bp, Homo sapiens
ttttttttttttggtagagacagggtcttgcttgttgcccaggctggattccgactcctagcctcaagcaatcctttgccttggcctcccaaagttctgggtttacaggcatgatccaccctgcctggcctaaagtttatcttgatgtgtggtgtaaagtttagcgggattatctttcctattttgactaattagagatgtttgatagaaaaaaaacagaatttttctatgtttattttttctttgttttatttttatttcccattatggcctaggctgttgaatatttactaaatactacgcagacatttcaaattataggtaaagcattaaaagatggtaaggtgtcaaaggaaaaatgattaaagatgcgcactattcttgcaagagatcagttgaaaatattttactgaatgttgtacttatattttccatgcattagtagtatgagccacattctatcaacttcacatttactcatttggagtaatgacactggtttctgctgtcaggaagtttatagtgtagaatattcacttaaatcggtgaatcacatgttataatgtctatgcctgca

SEQ ID NO: 401170 - DNA, 1239 bp, Homo sapiens
gtattttggaaaaatggtagagaagtgcagagtcaagtcatagcgactaataatgggttattttcttaaattgtatgcttatgttaattctcacagtctttttgtttgggtctgtgacagatcttacaaaagatcttttagacctatgattcttaacaaaattaaagaattaagtcggaaccaattttccacaatgtctcatctaagaaaggactcacagcccagcagcccaggagatgacgcaatggacaggagtgggctccctgaccttcaaggaagatttgagctatctgggaaaaacagacagtatccactggatgcattggaaccccaacccagcattggggatattaaggacattaagaccccaagtttagtattcttgtgtttcatatttgatgggttacaccaggcattactgagtgttggtgtgagcaagaggtctaatactgtggttgggaatgagaacgaggaaaggggtactccttatgctagcagattcaaagatatgcctaactttattgcccttgagaagtcatcagttcttccgccactgctgtgaccttttgataggcattgcggctggatcaagtgataagatttgcaccagcagtctccaagttcagagacgattcaaggcaatgatggcatctattggaagactttcacatggtgagagtgctgatctgctaatcagctgcaatgcagaatcagccataggttggatcagctcaagaccgtgggttggagaattaatgttcacacttctatttggagactttgaatcccctctacacaagctacgcaagtcaagttagttgccaagaaagcacagatgacaacctattaatgctgtgagaatgtttctagatcagtgcatggatggctccattgctctacgggccattgtgtctgagatcccagtctttgaggagaaaaaaaacaatggttaaaaaggcattggggaaatattttgagtttgggggtgtactttgccaccccattattggggagctgtcaccacgaatgttcccaaacttagcaacagcggcaaactactgggccaagatgagcaaccccacatttttgggatttaaagctcctgatgttataccaggatcaaccatcacactccctttgcttcaaatggcatctaccccgtaagatcttgaggggggagtgttgggtggaatcatagatccatgcactcctaacatgaactaattctcattatttaaa

SEQ ID NO: 401171 - DNA, 1293 bp, Homo sapiens
gtattttggaaaaatggtagagaagtgcagagtcaagtcatagcgactaataatgggttattttcttaaattgtatgcttatgttaattctcacagtctttttgtttgggtctgtgacagatcttacaaaagatcttttagacctatgattcttaacaaaattaaagaattaagtcggaaccaattttccacaatgtctcatctaagaaaggactcacagcccagcagcccaggagatgacgcaatggacaggagtgggctccctgaccttcaaggaagatttgagctatctgggaaaaacagacagtatccactggatgcattggaaccccaacccagcattggggatattaaggacattaaaaaagcagccaagtctatgctagacccagcacataaatctcatttccaccctgtgaccccaagtttagtattcttgtgtttcatatttgatgggttacaccaggcattactgagtgttggtgtgagcaagaggtctaatactgtggttgggaatgagaacgaggaaaggggtactccttatgctagcagattcaaagatatgcctaactttattgcccttgagaagtcatcagttcttccgccactgctgtgaccttttgataggcattgcggctggatcaagtgataagatttgcaccagcagtctccaagttcagagacgattcaaggcaatgatggcatctattggaagactttcacatggtgagagtgctgatctgctaatcagctgcaatgcagaatcagccataggttggatcagctcaagaccgtgggttggagaattaatgttcacacttctatttggagactttgaatcccctctacacaagctacgcaagtcaagttagttgccaagaaagcacagatgacaacctattaatgctgtgagaatgtttctagatcagtgcatggatggctccattgctctacgggccattgtgtctgagatcccagtctttgaggagaaaaaaaacaatggttaaaaaggcattggggaaatattttgagtttgggggtgtactttgccaccccattattggggagctgtcaccacgaatgttcccaaacttagcaacagcggcaaactactgggccaagatgagcaaccccacatttttgggatttaaagctcctgatgttataccaggatcaaccatcacactccctttgcttcaaatggcatctaccccgtaagatcttgaggggggagtgttgggtggaatcatagatccatgcactcctaacatgaactaattctcattatttaaa

SEQ ID NO: 401172 - DNA, 368 bp, Homo sapiens
atatatctggtttatacaatgttggctgttcagaaaaataaagcagagtaaggggatggggtgtaacccatgaagctgcattgtttgctcccagagaggctgtgtttatttcctctgttgcttatatagatcctatagatgcttgttgaatctgctgttattttagtttgagagcaagttgatatagtttcccaacctaatttatagagcccaagaaggttttatttgtccaagtttcttagtttaaatgggaccttcattatcctcacttcttggctttggggtatgagggaatttggaagttcccagattgaacatctgtatcagtgtctttctacctctccctccaccgtatgctgctgtgttgt

SEQ ID NO: 401173 - DNA, 184 bp, Homo sapiens
ttttgttatcttgtcatctaatcttattcacctattttaacaatcataaatggaatcaatttgccaattgatgcagtctgttagaaattgtaaaaacttttgtgttttttagtcctcttgtatttattgcttaaactgttttaaagttcctctgtagtaaccgtaaatgtttctagagttttac

SEQ ID NO: 401174 - DNA, 642 bp, Homo sapiens
agaattcgtgatatttgttacgctgtggcaaagttgttagtaaaactattgcttctcacattttaaaggatagcaatgggcttatttaactcttattccctatatggaaggaaatcttcagaaagctgttgtcttgctgtttcttattgtttgaaacaagttcttcagaagtgagatgaactcaggctagagctagccaacctgcaagcggagatgaaagggaatattgctttgataaaaggaggtgctatctgcctgcagcctgtaattgaaactgattgagagtatgataagtcaggaccattcagggcacaaaaatctgactgttatgctacgtggaatggaagcagttacatgccatggctacaaaacagtagtctttgtaggaaatatcactgtggcctaaaaactttttcaagcattttcctttaaaagttaagacaagacaatgggagctaattcagcagcaaagatcagattaaggatagtactttaccattgtgacaacacctctgcaggtgcttcacctcctcctaacttgacttctgattccagcctttctgtgtaagatttaactcactttgcctgttagtacctgtattagtcagggtttccaaggaaacaaaactaataggatataca

SEQ ID NO: 401175 - DNA, 849 bp, Homo sapiens
aaaagaggtaaagaaggtgggtttgaattcataaaattagctgctaggcctgggagggaggcagtcatttgttgagtgtactctgagtccctgctgtgtgaaggggcctgggtggggttgagcccacatacgtagaagggaagatggggcatatagagggaagtttgaaagttaaaattcctgtccctgctcagaggttttgttgctgactggagcctccacaatgaatcagacccacaaactctcagtccagtgaggaacagtgagatgccaccccaaactcatgatatttgccatgatagaggtggcacaggataccataggaaccctgaggatgtagagatgtcagagaaggcttcacaaaaggtgctgggtaggagtttgtcagacaaaaagaggagagaagtttcttggcaaagggaatagcaacatcaaagacttagggtctaaaaacaatctttctggagaactacacagggttacagctgacctttacaagtaccagggactttgtgtcagtactacttttagccccattttacaggtaagaagacaacctcagaggaagtaagtggtagagctcagattcaagccaagggcagtctggttccagggcctgtgtttttaaacacttgggtgtatctgtgtgtgtatatgtaagaggcagaggaaaagcattgcacaaagagaaagctgcacgcaggcaaaggctatggtattctcagaaaaggtgtgcctggccctctcggtaaagaggccaggctggctgggccgggtgtggtggctcacacctgtaatcccagcactttgggaggccgaggcaggcggatcacgagggcaagagatcga

SEQ ID NO: 401176 - DNA, 274 bp, Homo sapiens
attgcatgctactccctcaaacctttttctggtatcaacaacacatcttggctggtggaaactgcttaataacatttgcatgaaaatgtgtttagtcaaggtacccttttctcctctggccaaatatcagcattcaatctaatacaaaacacttgaattctctctggcagaaaatgcaatcctgagggatacgacaaaaaaaaataaaagctattttctgcctgattaatctgttcattagctacagggatctagaattagaagctaatgtaca

SEQ ID NO: 401177 - DNA, 366 bp, Homo sapiens
attgcatgctactccctcaaacctttttctggtatcaacaacacatcttggctggtggaaactgcttaataacatttgcatgaaaatgtgtttagtcaaggtacccttttctcctctggccaaatatcagcattcaatctaatacaaaacacttgaattctctctggcagaaaatgcaatcctgagggatacgacaaaaaaaaataaaagctattttctgcctgattaatctgttcattagcttctaatttctagatccctgtagctacaaaatgcctgtccttcagagacttaggccaattttgcctataagcctatgagttagcatatgtcttcacagtatcttggagtggctggaggtagagt

SEQ ID NO: 401178 - DNA, 498 bp, Homo sapiens
ccttgtgttttgcccgcctcggcctcccaaactgctgggattacaggcgtgagccatggcgcctggccccaaatcactttcaagtgcacttaaattagagggacagcatctaagtgtttagcaaaatgtggatattaaagaggaatatacatcgtcctgtgaggtagtgaaaaaagcaagacatggaaaactgttaaatattttcaagttttaaaaggcaaccgtaaccaaagtgttgtcatgactgagcaaaattgtgatgaccaaaaaataaagaaagaaataaattgtgacgacttatgaaaaattagttgaaattacaatttaaaaatatatgatgtttgtgcctctaggtcaaaactttaactgatttggttaaaaaattagagtactaagttcattttaagttacatgtttagtttggtgatttccctcccaattacaatgaaatcctaattgttgcaaaatgctaaataaatagattaaaaagtaatcaaa

SEQ ID NO: 401179 - DNA, 418 bp, Homo sapiens
gttgtttttacttattcccatccttcctacccttcttttcccatttataagtccctcccttctccctgtctcttttcctgtccttctcctcacctacttgcctttgtttgcccttcttttccattctccctttaatttctacctctttcctctccacaacttctaccttttccttcccaccatagaaaggagaatgggatattttttattatcacagctggaaaaaaatttttttgggggggatagagtctcactctgtcacccacgctggaatgcagtggtgccatcttggctcactgcaacctccacctcccaggttcaagcgattcttctgcctcagctactgggatgttcacttgagcctaggagccgtaatagcaccactgcactcctgcctaggtgacaatgagactgcttc

SEQ ID NO: 401180 - DNA, 1117 bp, Homo sapiens
agccgagattgtgccactgcactccagcctgagcgacagagcgagactccatctcaaaaaaaaaaaaatgttatcagtacttactcattgtgatgtctacatatagaactaaaattctgtttacttatgtgagtctttggctagagacatagaatttcagtcttgactgtgtgagcttaatttctggcatgtgggtttttattggctgcagaggaaacatctctagcagagatgacctatccctcaaatgtaggaaatacctgtgtaaacctaacacctgtgactcagaatagaaatggtaccaagtgagtggcttcttagcccatcagtaaagttatcacaccttggcctcccaaagtgctgggattacaggcctgagccactgtgccaggcctttgccatcagtttttaaaggaaatagtcactgagcactggatgctaggtggcaggttttttctttcagcttttttttttttttaaagccatcatactttaatatctttcagcactgtcaggttatcttctggcttctattatttctgttgagaatttagcccaggcatgggggcttatacccgtaatcccagcactttggaaggccacagtgggcagatcacgtgagcccaggagttggagaccagcctggccaacagggtgagaccttgtagctacatgtggtagccctttttcagtacattggccagtccagctcagctggatgtcatttacatatgtgtcttatattttagatacaaaagacttcttaaaagcttagagcataacacaaatatttatttgattgcgccatctaacaaatctgaataaatacatttcacgtctaggcattgcgttttgtatttctctaaaccagtgtgggcgtgtgtgtatgtgtgtatcactttacccagccacagcaagtgattatggatgaaatggctacagcaaagctaaaactatgatatgcctttgagaaaaaagttctgagctgagtgcattgtctcatggctgtaatcccagcactttgggtggcaaaccatgggaggattgcttgaggccaggagttcgagaccagcctgggaaatatagctagatcctgtctctgttggccaggcacggt

SEQ ID NO: 401181 - DNA, 832 bp, Homo sapiens
  misc_feature (106)..(106): n is a, c, g, or t
  misc_feature (285)..(285): n is a, c, g, or t
  misc_feature (288)..(288): n is a, c, g, or t
aaggcgcacgatgggcgtccgcttcctattcctgggttcaatgtcatgccctcagaggtcattcctctctccaggcaactcatctgggacttacaggaaacatccnatcaattctagtaaaacgataaggtatcctttgacctcagttaagaaataaaacttacgggtgatttttttcccttaaatttttttccagttagaaaataatggaatactcattatttacaaaacctgatatatacagacaagcaaaaaaaaatgttttggtcggccgggcgcagtggntcncgccgtaatcccagcactttggaaggccacagtgggcagatcacgtgagcccaggagttggagaccagcctggccaacagggtgagaccttgtagctacatgtggtagccctttttcagtacattggccagtccagctcagctggatgtcatttacatatgtgtcttatattttagatacaaaagacttcttaaaagcttagagcataacacaaatatttatttgattgcgccatctaacaaatctgaataaatacatttcacgtctaggcattgcgttttgtatttctctaaaccagtgtgggcgtgtgtgtatgtgtgtatcactttacccagccacagcaagtgattatggatgaaatggctacagcaaagctaaaactatgatatgcctttgagaaaaaagttctgagctgagtgcattgtctcatggctgtaatcccagcactttgggtggcaaaccatgggaggattgcttgaggccaggagttcgagaccagcctgggaaatatagctagatcctgtctctgttggccaggcacggt

SEQ ID NO: 401182 - DNA, 282 bp, Homo sapiens
aacaatgaaactgaggccatgagtgccaggttttatctgtggtcacccagccacagccaagcagtgacagatcctgtggcctggggtgctggtaggggagcttgggcaggaaggggcgtgaagggctgtgacttgcaggaggggtgagccttgctctatgagggcccacgacgccaagcccaggctatggtgggagctgagactgcagctcatttattctaaggaagcccttgtgaccatcagagctgcccaatggcagccgcaagcagctgtgggaggtca

SEQ ID NO: 401183 - DNA, 162 bp, Homo sapiens
ccacgctcacccgctgtatggggaaggctgcttccagagcactccggggcgtgtgttgagaatgctggtgctggaatcctagtgcagtaagccaggaatggaaagacttcagtaaatacaactggttagtgtgacgaggccacgggccctttggcctaatga

SEQ ID NO: 401184 - DNA, 393 bp, Homo sapiens
gcatacacggctaatgcccagataagcagcgcctaattgccttcgattcagaggcacaaaggaggccgttcacacctccccggctcctcgatgtctgggggaggggcggggctgcgggccctggttaatggagaggcgatggttcgggatcggtcacctcctttcatctctcccaaccccccaccccgcgggccgaggctgcaggaaggtaggagggtcccactcccacttgggcctgtcctgggaggtgccgggcgacctctcctctccagggggacgctggcgcctgtgcccagcccggacacccgagggcgagcaggcttcaggctgggagagtcagggcggacttaggttgggagcaggcttcggggtgggagagtcaggccggtgccc

SEQ ID NO: 401185 - DNA, 476 bp, Homo sapiens
cagtggaggtggacgggaggagatcgaggagctgggatgggggtcctctagggcaggggtcctagggaaacttctactgtggggtaggtgggctttggtttgggtcatgattttgtcatctatgagccttgtgatttggactattttctttctcaacttcagtttcttcatatgaaaatggagaggataggccgggcgcggtggctcacgcctataatcccagcactttgggaggctgagggggggcggatcgtgagttcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaa

SEQ ID NO: 401186 - DNA, 264 bp, Homo sapiens
ggtagcatgagaagagaaacccagagtggctaaatcacttgcctgggagctaatccctggtaactggtagagctgagctgtaagcccaggctcatcccgcttccaagctagagctttcaccattgcactgtgcacacacccgtctccttctcccttctgtccctcatgagtacacacagacccataattttagcaaatacgtcagtggccagagatgccacaacctagcttttacttaatttttgtagccttgtttaccttaaa

SEQ ID NO: 401187 - DNA, 374 bp, Homo sapiens
tgggcagggcccaggcatgagatcagagtcacaacatgtaggtgctgggccaagtgatatgtcacaatgcccactgtagacaggttccaggaagaaaaggagcatcacatcatctaggtgataaaccctgagatatctcacaatgacccctttgtgcagagatcacaaagaagaatcatataacctgtgtgctggatccagtgacagtgtctcctcagtggagtaaaagcctcacggtgtgttgaatcttggtctgagagtcgccaacccactggtggaccggatccacttacaagagtcaatgttcaaactttcaactgtctccagctgtgagattcagaacctcaacagtgagttgtgttcatgtgtgtgga

SEQ ID NO: 401188 - DNA, 1009 bp, Homo sapiens
tgggcagggcccaggcatgagatcagagtcacaacatgtaggtgctgggccaagtgatatgtcacaatgcccactgtagacaggttccaggaagaaaaggagcatcacatcatctaggtgataaaccctgagatatctcacaatgacccctttgtgcagagatcacaaagaagaatcatataacctgtgtgctggatccagtggtatgaaagtcaacacctgtattttgggtctaagtacatgagacacaatggtggacaatctatactgagagcctcaattcttcctgtagacagtgtctcctcagtggagtaaaagcctcacggtgtgttgaatcttggtctgagagtcgccaacccactggtggaccggatccacttacaagagtcaatgttcaaactttcaactgtctccagctgtgagattcagaacctcaacagggatgcaggttatgaagatgagagcgtgagacagcgagctgtaagggaagcaggttacccagggatggacagaggatgggccctggccctcatgttatgaagcttctccacgtggtgccttcctctgtcaaatgggcagaagaatatccttttgatagaattaaaatatacgaaaaccatttaaaaaaaaaaaaaaaaaaaaaaaaaaaaaaaaaaggaaaggacaacaacacaaaaaaagataatcccatcaacgagggagcccacaaaggttaacagcagataccccaagactttcgtggtcaccacaagtggggctcccaaatgaaggagaacccgatattttataaggactacggacgtggacggtaaggttaacaacacgctcgagaacaggggaaacaaccgggctcagccaggggaactcctggcgggaaagggaaaccctatacactgcggggggagggagcccccatcatgtgggacccaacacaaccctaccagaagaaattaaaagaccctaaggggaaaaaaatataacaagtttacaagtgctaaacggcggggta

SEQ ID NO: 401189 - DNA, 608 bp, Homo sapiens
acccaagtgttgagcagaggcagatgttaaaatcactcctgcaggaaggcccagggatgagattaacaatactgaacatgtccttgttttaggtatgaaagtcaacacctgtattttgggtctaagtacatgagacacaatggtggacaatctatactgagagcctcaattcttcctgtagacagtgtctcctcagtggagtaaaagcctcacggtgtgttgaatcttggtctgagagtcgccaacccactggtggaccggatccacttacaagagtcaatgttcaaactttcaactgtctccagctgtgagattcagaacctcaacagtgagttgtgttcatgtgtgtggatgacaatctttattgtgggatgggggtgcatatgagtgttacagtctcatctgtgtactaggccctgttaggacgcttactggcctgaggctttaactggtatgcatgagagtcacaattctctctgagtccctatgttggtattaacccatgatcatacctatggccctgaacccaggtatgagaaccaacatctcttcaactgtctgggtccagataggagagtcttctactggctataagctgggttaagaaa

SEQ ID NO: 401190 - DNA, 847 bp, Homo sapiens
ctcaaatgccctccccccaaactcctatcacctggaagcctctactaggcctgtgccccattccagggaaccctctgctcccatccagggccctcatttcaccccttccctgaagcctgtctgcggctgtccccacctccctccagccaggggagggtgctccctgaccagatggctccacctgtcactccctgtcactatggtggtccttcctcctctgaactctgggaccttgcagaggctgctcaacacctctgagctcgaatctctgctccaggggatgcaggttatgaagatgagagcgtgagacagcgagctgtaagggaagcaggttacccagggatggacagaggatgggccctggccctcatgttatgaagcttctccacgtggtgccttcctctgtcaaatgggcagaagaatatccttttgatagaattaaaatatacgaaaaccatttaaaaaaaaaaaaaaaaaaaaaaaaaaaaaaaaaaggaaaggacaacaacacaaaaaaagataatcccatcaacgagggagcccacaaaggttaacagcagataccccaagactttcgtggtcaccacaagtggggctcccaaatgaaggagaacccgatattttataaggactacggacgtggacggtaaggttaacaacacgctcgagaacaggggaaacaaccgggctcagccaggggaactcctggcgggaaagggaaaccctatacactgcggggggagggagcccccatcatgtgggacccaacacaaccctaccagaagaaattaaaagaccctaaggggaaaaaaatataacaagtttacaagtgctaaacggcggggta

SEQ ID NO: 401191 - DNA, 948 bp, Homo sapiens
gacgccggtgaataacttcccaccgccgcggaaccgggctcagcaaaccccctactgcctcgccccggtgcattgtgcttaatggacgttcgaaggagtcagccacccttgctgtgttctgagaggagcctggagaatgaaggagcccgggcactcaccctcagtggaccctcgcagtgggaggggggtgtcattcttctctcagaattaaggttaatagccgagttcgagttctcaccaaattaatttggggttggagctcagtaagactggttttcaggtaaccgacgagggaccgaaacggccattctgggttgcgtgttacggtgaacagcaaactgcatggatgtttgagcaccctcagtatctgtaactaaaaccctgaaatgcggtctcgctgattgagttgctaccctctggggagactaaaggtgctggactgggtctggtccctttaggagggtctgtgcttggtagaaagtaatcgtgtttcttccaggcagattgtgttgatgacatttaataagagacgtgtgtcctgaccaagtatgattcggaatgttcctctattcccaccacatgtcacattagtcacttcttaaggaaggagtggtcctacaccagttatcagccacccataccctctggcccttttccagccgcagatttctccccatcttcaggtgccacgtctccccatgggtcaccccagccggcatacacaatggtaggccgtctagagtctgcactattctagtattaggctactacagccatgaacaaaacaggcctgccttgggtgaggggatgccctacgtggtcaagggtcctctgcattgatgcacccccctaagagttttccaagaatgtgggtcccaaagaattttgactgtgctctgtggcattctgtatagaaaactgagctccttggctggtttctcaaaaagc

SEQ ID NO: 401192 - DNA, 436 bp, Homo sapiens
aaaaaaaaaggtaaagcatagtggccgtgggcatggagtctgaagacagctatcgggttggaaactggctcctcctccacggctagttatgtaacttggctcagtttcctccgttgtaaaatggggatactggtgccagccacccaagagtcatgaagatgcaatgaatgcatgtatataaagttctttgaacagccctggcagagtaagcccatgctctgctgctgctcctaaccgaggtacctccaccagcatgcataagtgtcactggtagcacagtgaaatgcaggtgctcaggccctgccccagactcttaagatgttagtattaaactctgcttaactgtgatgagaatgtagcatatataaacatatatgaattacatttgaaattgaggaatgatttttaaaataaacttatcaattgttgactagta

SEQ ID NO: 401193 - DNA, 463 bp, Homo sapiens
cactggtattaaaaaccctgacatatagactgtggaagggcatgaagggagggttcttatgcagacatgcttgatagcaagaacaatcacaaaagactgcaaaaatcacagccgtgcacaaagaccatcacaacttacacacacaaacacttctgggaagacatctgcccagtagctgcctgtccagcctcagactggcaccatccttcctggagatccttgtagccaaggatcattgattcaaaacaatgatgtaatcctcctgtttcctttgaaaatctttgtcttcctttaccttccttgacccacacccaatttacgatggcacacatattctattgcaatgaatgttcccgagtaaatctcattttcttttagagagcctctctctgttatttagggtgacagtgggaaaatcccagactgcaaatccttcctcaacaaagggcaaacgtttcctcca

SEQ ID NO: 401194 - DNA, 185 bp, Homo sapiens
ctgaagtccggattcctacacatacactcacacatacacaaggaaactcactcattcccatacacttacccatattcacaaatacagttgccaacacaatcacacaggtgtcgacattcatgaacacatatataaaaatgcataccagaaacatgcacatataattatactcaaagaaccaggta

SEQ ID NO: 401195 - DNA, 919 bp, Homo sapiens
ggaggcagagttcgctgttcaacctttttcagatgaaaactaccacgcttcaaggaggctagcacctcatccatgggtgagctcactttggaaaatgaaacagaacagtattacagttaggactgcacttaattagaatgaaactgtataacctctaccgttcgcaactgtgaaagcacaggacgctgaaacaccatcttcaaaatggatcatgaaatgtgtgcagaaggtgatcagaacacaagggatcctaattatccttctttttagaaaatcccaagacccaatccatggtgggtactgttggtattcctatcatttcctacatgagagaagtgaccagattgggaactgggaggtggtcttagtagtattatgggtgtgattcccaaaggatttccatattgcagttgctccacccaaattcagagtgatggggttacacattttgtttttaaaaattaatttttgtttattatggagactgtgcttttttcatttagttgttttacatgtgaaatcctactcagattacatcaagaaatgttttatagaatggtccttcaggttaaaatgtaatatacaagtaatatgtaacatttatataatgttctccccatgcaaaatgcaaattccttaaaggcaaaaggcaagggttattctctgctctttttagaaataattttatttgtgcttgaatctctcttaacaaaaaaaattagaaaaaaaaatagtaaccttattgaggcacatctgtcacattgtaagttgaacagattactccctgttcttctttgcttctttatacaaatacacaaaagtcctcaacaaatgtatgaacaaatgttacatgatcctgccaatgtcttccctgtggtgacagtccttaccagatatcttaccctttctgatatgagta

SEQ ID NO: 401196 - DNA, 133 bp, Homo sapiens
atcatgcagcgtcttgtttattctgtgatctgtgacccggttctgtggaaaattatatgttcttattttctctgatcttcctttacttccaatctgaatttttctagcattctgtcttttatttatttcttct

SEQ ID NO: 401197 - DNA, 278 bp, Homo sapiens
tctcacaggaaggtgttagataatgggcacaaggaagcaataaagaagacgatattggataacaggcaaaaaggacccaacacaagagagggagtaagagaatcctcaggatggcagttgtgcagcaggctaggtagcaagagttcatattggagcaaatcagaaggctctgcagaaatgtttacaagaagattgatttgatagtatacttgatatatttgaagtattgagagagttagaaaattgtggaagagtttaggaagaaattagaaaagaaa

SEQ ID NO: 401198 - DNA, 643 bp, Homo sapiens
gcaggcaagggactaaggggaggggggctcagtgccagctgcttaaaaatgcccctgtggcagcgaggggcaccagaggctgggtctaattagttgagaagcagtgacacccccaaccactccccaaacaggctggctcccgtctccaggccccaaggagccacacctggaccagaccccaggaaagccaaagatggagactatggtacactcttcacagccaagggcaggggacagaggagaggcggtgcccaggcaggatgcaactatctccaggagatagttagaggatggcagcctatcttgagttctggctgctctgcccaggaggtccctttgaatggccagagatggtctccaatgctgttggcctcctgcagaagaaagagcccaaggctgggaatggaaacccttggttctattcctggctgtgccctaactcttcatatgaccttcaacgcgaccttgaacatgcagcttcctctggcctcagtgtgtccagcgagaggctagacccggccaggcctggtggctcactcctataatcccagcactttgggaggccaaggcaggcggatcatgaggtcaggagtttgagacgagcctgaccaacttggtgaaaccccctccactaaaaatacaa

SEQ ID NO: 401199 - DNA, 506 bp, Homo sapiens
ggcattttcaggtagtggccagaaactagaaactgctcttttctggttaaaaacgtttgtgacccataaaaccttctcactgcttactaaatagcacagttctgagatacaaaccagcaaatttacaaatcacaatgcttttcctgctgaatcaatagctgtagcaaatatatatatgtaaaatgcaatggaaaaatgaagacctctttagaagcctgcagaaaatttatactagatatgaaagtttgagcaatcacgtaaaagccctagtcccttaacattgcttttaaggtcatcagtgtcctggacgttggtgacttccctgcacccatttcttcactccccaccttgaacttcatgtttaactcttatttcttccagtacttagtgaacactgtcttctctctaagccttttcctggaggaacattctcttgtctgacttcctaagtctgagttaagtggtctcctatgtctcctctaataaacttattttaccctgtcaaa

SEQ ID NO: 401200 - DNA, 465 bp, Homo sapiens
ttttcctcctacctcctgccagctccttcttaggctccattgctgggttcttttccccttttgcagtttgagcgtgccagggctctgtcctgggccatctttatttctctaaatacattaactcctgggtaatttcatctagtcccatggagtgacagttaattttatgtgtcaacttggctagcatacggtgcccagttgtttggcagataaaagcatagatgttgctgtgaaggtattttttagatgtgacttacaatgaaatcagtaggctttgagtaaagctagtgaccctccataatgtggatgggcttcatccaattagttgaagaccttagagaaaagatggaggtttcccaaagaggaagcaattctgcacccagaccaccgttagtctcaagattgccacatcaatgcctgcttgaatttccagcctatcagccagccttggagttttcagactta

SEQ ID NO: 401201 - DNA, 571 bp, Homo sapiens
aaatcaaggcataagaaattaagtaattttccaaggttactgtgacataacaaaaaatatatattcagtctttgcctctggttcctggcatagagctcctaaaactcttggaatttcctgaatgatagacgtaagaggagcatatattttgttatttataataagcacctttcaaccacccctgaatttatgctagtgaggtgactcttggaggatgggggctagttgccaggataaccaaccatgtgattagaggattagaacttttaacaccaattccagggaggaaagaagggcaggagattgaattaatcaccaatgatcaatgatttgatccatcatacctatttaatggggcctttataaaaatcctatgctatggggtttggagagcttctgggttggtgaatacattcacatgttgggagcacggtgcacctcaaattccatggggacagaagctctgatgctcaggactcttccagacctcaccctatgtaccccttcatctggttgttcatatgtatcctttataatagcctttgcaataaactggtaattgcaagtaaag

SEQ ID NO: 401202 - DNA, 238 bp, Homo sapiens
cgggtaccctgcgtcactccagtatttaaaggtcatggaggaaggaaagaacctgcaaaggagacagagggtagtagccagtgaggaagaacaatcaagagaggagtcccagagctgggcacggtgactcatgcctgtcatcccagctactcgggagtctgaggtcggaggattgcttgaggccaggacttgaagactagcctgggcaacctagtgagaccctgtctctaaaacagtg

SEQ ID NO: 401203 - DNA, 254 bp, Homo sapiens
actcttcttccagcacctacagcccacactgcttgagtttctgacacaagcctagattccatgtatcctggggtcctcaggacttaggcaccactgcctcacctctggtcgggtggggaaatgcaatgaccaatatttcgactactgctttctctggtgctggtttcactaagccttctgtattgaatatagttaggttagacaaaacaaaacaaaaccaatgcctttaagtaaataaaagcattttatataag

SEQ ID NO: 401204 - DNA, 460 bp, Homo sapiens
tcttcattgaatcctgtatggtcatttctattagaagcagctaactttccacactttgaattctggtagatataatggtgtggagtgaaacgtgagttttattttattattattatattttagaaaaaaagccaatttagtatgcttattaaaagttttccttttttagggcaggcatgatggctcacgcctgtaatcccagcactttgggaggccgaggtgggtggatgacttgaggtcaggtgtttgagacaagcctagcccacatggtggtaccctgcctccacaaaaaagtataaaaattagctgggcatggtggtccacacctgtaatcctagctactctggaggctgaggtaggagaattgcttgaacccggaagacagaggttgtagggagccaagatcgtgccactacacttcagcctgggtgacacaatgggtgagactccatctcacaaa

SEQ ID NO: 401205 - DNA, 604 bp, Homo sapiens
aaaggaatgaggtatattcctccagcttataaattattacagaaataacctgcaatgtggaaaagcatatcacaacaaaagtataagaaacaagttaaatatccaatattagagaaatgcacataaaacagaatattttccaggaaatacaaatgaagtttagaaaaataacacaggaaagggtttataacacaatgttaagcaaagaaggaggcactacaaaaaagatacaagttataaattataatttcaacaatgcaaaaaattacagaagataaatgcttgaataaaatttttaaaaaatggtaacaaaaatggcctctggataatgcaatggtgtttttttggtcactcttctttatattttatgtactttaaaatatttatcaggagtgtacattacgtttcaacagaaaagatctttaattataaaatgaaaccattatgaacatacagaattatataaatgggaaatcatagataaatgttatttggatgattaaaacatttaaatctttgtttaggaaacatcaatacagtaataaaggtcacaagcattcatgattaatttattgagaggatactatgaaaccataaaaatctg

SEQ ID NO: 401206 - DNA, 209 bp, Homo sapiens
taaatcttcatagagaataaatcaattatgtatgtttagtaaagtgtggatttgtaataaaaaagccacagcatgtccctttaatataattgtgcccaaatttaaaaaaaatgaagctaacaaatacaaatgagtaggaaaaaatatttaaactgtaaagtaatatctctggtgtcagaaataaagtccatttccttcagttgtgttat

SEQ ID NO: 401207 - DNA, 265 bp, Homo sapiens
atccagctacagtccttgccttcatgggctttcagcaaagtaatctactcctcacacttaattctcctgagaaggcttcctggatacacttgagaatgaactccactttggttatacagacacatggaactccatcactgctgttgctgagaaaatatcaatggctacattattttcaactgctgcctatgagttatatcagagattaattgatcagctaaatgagaaaatgcagagaatacacaaggaataaatcgatgaagga

SEQ ID NO: 401208 - DNA, 469 bp, Homo sapiens
gattcccagtcctagctctcttctgggcctcttctgtcctagtcattctccgccagtggctacctcttcctttgttctttgccaggttacccctctgtgctccttcctggcccatgatcaatcagttccaggccacagcaggctgattggcttatcacagggctctcatttacatcatagagttctcagtctttctgtccagcacctgctcaaaactccttccttgaaccaaggttcttaatctaagagctctattggtggttcggttgctcagttatttctgtttctgttggtaccacacatatgtctgcaaatgtgcgagatgtgggggagactctctttagtgagaaggggctctgcctgtcaggaaggcctgccctgtacactgctgaggcttgcctacaaaaccccattgtgcctgcggtgaaagaggtcttctcagtttccctctcatgtagaggggaggaaa

SEQ ID NO: 401209 - DNA, 447 bp, Homo sapiens
attatggcatttgggattgtgtcttttgggattatgtcctaaacccaaattctgtcaccaccgactgtctagtgataacatttaaaatggaaagataaaatgacttgattttttttttccctttatttttaactgcatttaaaaaaatagaggctgggcatggtggctcacacctataatcctagcactttgggaagttgaggctggtggattgcttgaactgaggagtttgagaccatcctggtcaatatggtaaaacatcatttctacagaaaaatacaaaaaaattatctgggtgtggtggggcctgcctgtagtcccagctacttgggaggctgagatgggaggatcacctgatcacctgagcctggggaggttaacgctgcagtgagctctgattgtgacacggcactccaccctgggtgatagagtgacaccctgtctcaa

SEQ ID NO: 401210 - DNA, 526 bp, Homo sapiens
tcagaactttggtgcatttgaagtgcctgacaatgtagtccagcttccctcctgttttacctagagggctggagatatgagggcccaaaggggccacaactattatcttaagtggactgaaaggaagacgaaattaaaactagcttctactccacttgtaggaaatgtgcttttaatctttggtgtagcccagccttctaggaacaaaagtatcctatgttggcaactgcagtaacaaaacagttatggagagtatggaggagagccagtaactcctaaaggtcttgttcctttgacttttcttctcaaacaaacatgagatattcatgaattgcaatggcaaacgttttttaggttcgccaatatgaaaatgtaaagcagttttaagatgattaatattaaaataggccaagtgcggtggctcacaactgtaattccagcactttgagagcccaaagtgggaggatcacttggcctccgaagttcaagaccaacctgggcaacacagatgtcatctctagaaaaa

SEQ ID NO: 401211 - DNA, 307 bp, Homo sapiens
gaatttgaaggaaatagagataatgcaggaaacagaaaaaaaaatttaaataacataaaattctcagaggtaagaaacaattataactatgaaacaagaacagaatgctatgcaaacaggaaattactgtatttggaaattgtaaacatgataaccaaaattaaaattttaattgaaagactggaaaataaaacaaaggtaatctctagaagttagaacaaaaaaaaatgaaaatataagaaagtataatcgttaaaaattcaaactattagaagttccagaaagagaaaataatagagaacaaatc

SEQ ID NO: 401212 - DNA, 420 bp, Homo sapiens
atgcttttgaaaaaaacctgctttttggttctccttgtagggaaagtacgaagtacacagtaagtttgaatccctagcatgatcagaatgtctgaaaccagaccctttggtaatgtagaaagaaaatgcacatttaaaaagttgtcaaatataaaataagttattttaaggaagttccttttttctctctcacctttgctttagtggccatcaatgataaattaagttattgttaagcttccatttttcctcctccgttcattgtttccgagatttcggccactgaggaaccatggtaatgactttgccacactggagaataccgttacagtattagttatttactattttttcttgacattgacatttaattgacattttgattgacacttaaaagtttcattctaaataatacctacg

SEQ ID NO: 401213 - DNA, 641 bp, Homo sapiens
atagagttcagcctttggtgatgagtggcggatccattaacataaattttggacataacacaatccaactaatactctggttaaccataatagggaagaggttatttccccctttctttttagcctaaacttcctgctatatctgtgcttcccacatcaagatttgtactactatttattggctttctatcaggttctgactttgaagaactcttctcctaccaagtaaatagttagtggttagcaaaaactggtaaggggcattatctttcaagtaagacagagtaactatgccttacattcttcgacacaaagatggaacaatctcaaatttggatttctagcacagctgaataatgctctgtaaggaataaactaccagccatgcctaaaatattggtcttttgcttgaagttcttcatgttttaactggaaagttaaaaacaatttcccaactgcctatttgccccttgtgtttatttattatttttcatgtttaattaaaaaacacttctactttaagcaaacatttcccttttttccctttaattacctgacaaacggtagcagagctgcataaattttgcctgaggttaaagctggagtaaagcctaatcactagcttgagacattgttctggc

SEQ ID NO: 401214 - DNA, 582 bp, Homo sapiens
ctgttcatacacaccagctatcaaggaaatgcaaactgtaaccacaacaagataattatttacttaataaaataggctaagcttttaaacagttatcatgccagtgctgtgattgggtaaggcaatgggcaaatatggctggctgagtacacatgggcagcatcttcctgcagagtggtttggccacagttgtcagaaactttgtacacctagggatttatcctgaggaaatagctgtgaaatacatgaatttgtatggctcgtacatcccattgtacacctaggcacttatcctgaggaaggagccgtgaatatttagaaatattgacctggaacatcacggtctagagaagagaaaaattggtgataatgaaaatttctaaaaatgagacattacataagtaagttatgaaatactctaaatcaagtacttagggaaaaataaaacaacaacttaaggcttatctctggtatttagaagtatgaatgactttcttctttggacttttctgaaattttccaattgtcctcagtgaatttgtattatgtttataatccagtacaatgttacataaagtttta

SEQ ID NO: 401215 - DNA, 1426 bp, Homo sapiens
ggatccgcgtgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctccgggggttcgcgtttcaggcgctcgtgttttccgggaagggcaggcgcgctgggccttggggagctgcgctcggcgggcggaccgggggatcatggaagctgataaagatgacacacaacaaattcttaaggagcattcgccagatgaatttataaaagatgaacaaaataagggactaattgatgaaattacaaagaaaaatattcagctaaagaaggagatccaaaagcttgaaacggagttacaagaggctaccaaagaattccagattaaagaggatattcctgaaacaaagatgaaattcttatcagttgaaactcctgagaatgacagccagttgtcaaatatctcctgttcgtttcaagtgagctcgaaagttccttatgagatacaaaaaggacaagcacttatcacctttgaaaaagaagaagttgctcaaaatgtggtaagcatgagtaaacatcatgtacagataaaagatgtaaatctggaggttacggccaagccagttccattaaattcaggagtcagattccaggtttatgtagaagtttctaaaatgaaaatcaatgttactgaaattcctgacacactgcgtgaagatcaaatgagagacaaactagagctgagcttttcaaagttccgaaatggaggcggagaggtggaccgcgtggactatgacagacagtccgggagtgcagtcatcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaagaatgaatatgcttttccttaaaaaatgaaaactttaatttttaccatccatttatgtttagatacaaaacttatttccatgtttctgaatcttctttgtttcaaatggtgctgcatgttttcaactacaataagtgcactgtaataaaaagttttgtttat

SEQ ID NO: 401216 - DNA, 462 bp, Homo sapiens
gctaaagcagagaagaacctaaaacggactcctcatagtgagctaatattttataaaaaggtgtcaatcaaggtgtggcttacaaaaatactttcaaggatgtttactttccagccatctcactggacaagaactgggtggttttcattaactttggactgtgctttaatttcctaaaaatgatgtcacttactgccctgagtgacatgggatgggatgctgtggtagagcacactctggctgatgtcttgtacctgctggagacagaaaaggatgggagacacagtcctccacaggaaatctcaaatgggtccctctttcttttcagatatggactttctggggagtaatactgtagggcttttcttgttgttgcctttaactgtctcaaatgttctcccaaagatgctactgaacacagcctctcctttgagcaagttaaaagtctgggtacgactgcga

SEQ ID NO: 401217 - DNA, 439 bp, Homo sapiens
cagtggctcatgcctgtaatctcagtgctttggcaggtggagatgacaggattgtttgagggcatgagatcaagaggagcctggccaacatagcaaggccctgtctctacaaaaaaaaaaaagagccaggtgtggtggcatgcacctataattcgagctactcaggaggctgaggcaggaagatggcttgagcccaggaatttgaggctgcagtgaactctgatcatgccaccgcagaccagcctgggaggcagagtgagatgccgtttctatgctaaaaacaaacaaacaaacaaaaagatctaaaggaaaatcacactgccaagacactctgacattagggcctagggtgttctgcttattgcaatagcctgaataaagccatctccttaattgtcaagatcacgccactgcactccagcctggagaccctgtcatt

SEQ ID NO: 401218 - DNA, 1301 bp, Homo sapiens
cattatttctaggtatatctgtgagtgtgtttccagaagagatcggcatttaaattagtggactgagtaaggaagatctgccctcagtgtgggtggacgcagtccaatcagctgagggctgcattcaacaaaaaggcagggaggaaaggtgaatgtgatctttattctagagcagggacacctttctttgactgcccttggacatcagaactccgggttctccagctttcggacttggacttaacaccagcacaccccccgccccaggttcccaggccttcggcctcaaactgaaaattacaccatgggcctccctggttctccagtttgcaaatggcctattgtgagacttctcagcctccgtaattgggtgagccaattcccctaataaatttcctctcatttattaagagatttataggtatataggcatacctttgagatctctgagatatttttatagttcagttccagaccactgcaaccaaatgaatatcacaataaaatgagtcgtgaagtttttgatttcccagtgtatataaaaattatgttgacattatactgtagcctatcaagtgtacaatagcattatgtctagaaataccttgtacatagcttaatttaaaaatactttattgctaaaaaattctgacaatcatctcagccttcagtgagttgcaatcttttggctggtggaggatcttgcctcatgatggctgctgactgatcaggtggtggttgctgaaggtggggtggctgtggcaattttttaaaataagataacaatggagtttaccacatcgattgactcttgctttgagggaagatttctctgtagcttgtggtggtgtttgatagcattttactcacggtagaactttgtttgaaactggagtcgatcctttccatccctgctgctgctttatcaactaagtttatgtaatataccaaatcctttgttgtcatttcacaatattgacagcatcttcaccaggagtagattccatctcaaggaaccacttttttaaaatttttaatttttagtggtacctagtagatatatatttatggggtacatgagacattttgatacaggcataccacatgtaataatcacattagggtaaatggggcatccgtcacctcaagcatgtatttctttgtgtcacgaacattccaattatactcttttagttatttttaaaagtactataaattattgttaattgtagtaactctgttgtgctatcgaatactagattttattcattccttctatgttttgtgcccattaaccatcc

SEQ ID NO: 401219 - DNA, 638 bp, Homo sapiens
attggaaaaaaacaatatcggcaggacgaggccgcgctgtgcggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaa

SEQ ID NO: 401220 - DNA, 600 bp, Homo sapiens
tggctagtagaggctgggggttgaatcggacgaggcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaa

SEQ ID NO: 401221 - DNA, 710 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401222 - DNA, 314 bp, Homo sapiens
ttttttgtcaagctgttctttatttcagggagagcaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaa

SEQ ID NO: 401223 - DNA, 238 bp, Homo sapiens
cgttaagttattatgtgatcgtgggcgcaggctgaaggggggccgtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaa

SEQ ID NO: 401224 - DNA, 2234 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401225 - DNA, 1541 bp, Homo sapiens
acttaggctaggtacgaggccttggtgttaggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctca

SEQ ID NO: 401226 - DNA, 2160 bp, Homo sapiens
acttaggctaggtacgaggccttggtgttaggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatggtaggcaaagtgaacttggctctgctggcctctttggggtcacagaaattgctccttgtggtaatcttatatttctgtcaggcacagggccaagaagctgtgtaacagacattactttgcttgcatctctttttcataccttttccctctgaggcagcttttgcttagaaaacagtcccttcactctgcctttcctcctaacttcctgtgcctcttcatgttctgctcaagctttttaaagcaacgaagctgttggagaacttaaatccttgcaactgagagataagctacttaaaggcggtagagatcttttttttttttttttt

SEQ ID NO: 401227 - DNA, 2202 bp, Homo sapiens
aaattaggctaaggtacgaggctgggtgtcgcggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401228 - DNA, 2768 bp, Homo sapiens
acttaggctaggtacgaggccttggtgttaggaaggagcggcggcgacggaggaggaggatggaggcggtggtgttcgtcttctctctcctcgattgttgcgcgctcatcttcctctcggtctacttcgtatccttgcctgaggcaggcgaacgccttgccgggggacacggctgagggtgggccagttgggcacccgggcaggtgtgtgggactagggaggcgcccggcggcgggcgtgggctccctgggagctggcctggccggggcggtggcgcgggccccggagcgggtaggagaggctggctgccctacccgacgggccctgctgccctgcacgcacttgccctgcctgggttgccggccgcccctcactcgggtccgagtgggcctctccgggcgcgccccgtctcggcctgcccgcctgctctccgctcgtccccgcggcgcccggaccagccctgcctgagccacggccgccctcgggagagaagcgtcgctgtttttctgggagaggccctgcgccgtgctcttcgtcggatattgggggtcccaagggcggtcgcttgcgacagtcgggtgccgggataagtgcgggccatttgcctcctcctgttccccacgcaacacccccggcacccgcccctttgttctggcgggtgttagtacttgcagggacctttcacatccaggagttgactcattcgccaaaggagcgaagttgcttccttcactgtgccgttttgtatgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401229 - DNA, 2509 bp, Homo sapiens
attgtaagcttttacattcttattattttttgtttttctctgaatatgaaatggtttcctcgggattctggagattggaaaatgtttaacgttgctattctgacttgaaaggcaacatgtgtgtggatatcagacatcccaaattagagctaggggctttggcatagatactagaataggaactaaacaatactctttttttctctagttctcattcaaatctgcttaatgaatgaacctaagcctttgcttaggataaaaagtaattgaaatttaagtgctttatttttaagttgtgccctgatatatttgcatgggatacaaagttatagcagtatgcaaatctgggacatgggagtctaaaaataatcttgaaacagtagcttgtaaattctctgtacgttcattgatttagtttcaaataacatgtacagtcaggaaggacatagcagtgagatgtaatactgtgttcttccattgcagtgggttgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401230 - DNA, 2184 bp, Homo sapiens
aagcagaccaagcgcttcgtggcagcgaaagcagcgtgcggggaagtcactgttaaagtgctgcctaaggaagtttggaaatagtccccgttccagattgccttgaattttaaaacattttgcttagggaaagtaggtcagcagcacctaagatcaaggatactgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401231 - DNA, 916 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaagcaagagagaagaaggaagcgagaaagaaaagagtgtgggggagagtggggacatgggaaagagattgaggaacgaaggtggggggagggggccaacgaaggtacacggacacagtggcacaacggccacaaagagaacacggcaaccagaaaagggggggagacctcacaagtgaaaaagccccgggaccgggcggcatgtaaaaccacagaggggtaggaggacgaggagacacaacgaagcacagggcgcgaa

SEQ ID NO: 401232 - DNA, 2714 bp, Homo sapiens
acttaggctaggtacgaggccttggtgttaggaaggagcggcggcgacggaggaggaggatggaggcggtggtgttcgtcttctctctcctcgattgttgcgcgctcatcttcctctcggtctacttcgtatccttgcctgaggcaggcgaacgccttgccgggggacacggctgagggtgggccagttgggcacccgggcaggtgtgtgggactagggaggcgcccggcggcgggcgtgggctccctgggagctggcctggccggggcggtggcgcgggccccggagcgggtaggagaggctggctgccctacccgacgggccctgctgccctgcacgcacttgccctgcctgggttgccggccgcccctcactcgggtccgagtgggcctctccgggcgcgccccgtctcggcctgcccgcctgctctccgctcgtccccgcggcgcccggaccagccctgcctgagccacggccgccctcgggagagaagcgtcgctgtttttctgggagaggccctgcgccgtgctcttcgtcggatattgggggtcccaagggcggtcgcttgcgacagtcgggtgccgggataagtgcgggccatttgcctcctcctgttccccacgcaacacccccggcacccgcccctttgttctggcgggtgttagtacttgcagggacctttcacatccaggagttgactcattcgccaaaggagcgaagttgcttccttcactgtgccgttttgtatgggtaattccagaattgattggccataccattgtcactgtattactgctcatgtcattgcactggttcatcttccttctcaacttacctgttgccacttggaatatatatcgcaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401233 - DNA, 851 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401234 - DNA, 1583 bp, Homo sapiens
cagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaatttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401235 - DNA, 1436 bp, Homo sapiens
cagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaatttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401236 - DNA, 980 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaattacaaacaaaaaaaaaaaatccggggcttatttcggggcggaaaaagggtgcaggcctggctacggttccgcccacttctgtcaaggggactcgccgccccaagaacgtaagaaccgacatcaaaaca

SEQ ID NO: 401237 - DNA, 1136 bp, Homo sapiens
gccacattgtaccaacagctgtatggcaagaattaagactcaggctgggtgcggtggctcacgcctgtaagcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctataatggcagtacccagggcccggtccatagactactatcgagtgctcctatgtgcatcttagtacgtatcattttcccttgcctttttccttctatcctttcagtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401238 - DNA, 987 bp, Homo sapiens
cagatattcttagtaaccaaaacagtgactcatgcagttgagagagcctttgggctgtcagtttacagtacatcaggcttgctgaggctaagcaaatcagaaaggtgccatgtttataacagaggtcaaagctccttacttctgaaacattagctgtggttaaaaacaaaaactcttccttcttgtattgcttgtctatcaaagccaggaaagtgggggatcactgtagttaaatttttttttttttaattagagacagagtcttgccctgtcgcccaagctggagtgcactggcgcaatcgtggtacactgcagccttgaactcctggactcaagcagtcctcctgcctcagcttcccaagtagttgggagtaggtgcacaccaccatgcccagcgaattttttgtagagacagaggtcttgctatgttgcctaggctggtatcaaaattactggcctcaagcgattctcctgcctcggcctcccagatgttgggattactggtgtgagccaccacgcccagctcaaaaacaatttttttaggggcacttctacaaatcatgaaagggggataaaagcactgactttaaaaagccatgtttaagatgctataaatgttctccccttttcattgattggagagttgtagaggaccttagagatcattttgtctaactccctcatcccaaagataaactgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcctagagatcgttcagggtgttgtaactgggaacatctgaatgctgaggcttagtccagtgttctctctcccttaccactcctcttccccttccctctatggaccgggccctgggtactgccattatagaggtcgacc

SEQ ID NO: 401239 - DNA, 302 bp, Homo sapiens
agtcactcttttttagtgaaaaagtttggacatgaaagatcctaatatattctttcctttgggtatgaatgattgtcttttactcaaatgattgttcctttgtgaaccttagggacgcaagtctggacaaaccaggctctgtaggaacattcctgagaaaacattagtgacattcatttcttctttccacagtatgatcttagctttgataaatgactgaagctggagaagccgtggttgaagtcagcctacactacagtgcacagttgaggagccagagacttcttaaatcatccttagaa

SEQ ID NO: 401240 - DNA, 529 bp, Homo sapiens
atagccattgttttacatttgaagaactcaaactaaatgttctggttgggtcagattagatttgagcaaaataggattattttgtaaaataatttgttgaaggaacatgaatgggaaaattgagttgtctaatgagcaaactttaggaaacaactcatttttttcaagtcaaatctaattctgccttgtaactgggattgctttctgaaacttaaatacttagttattataaaagaaatataataattccttatcttgatcatcagataattacattgtctgatttagaatgtgattacattaatgctagatcatgttgctcaaaattaaacaagaggtaagacatttctttgctcattctctggcattgaagccaggtcattttccatacttaagattattatagataacagatgtatttttgattttagagtacatgttgtctcttattcattggaaatttgatggaactgctgtgttttacaatattttagatcatgaaattatgctagaagatctgacttgaaat

SEQ ID NO: 401241 - DNA, 660 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaa

SEQ ID NO: 401242 - DNA, 2218 bp, Homo sapiens
acttaggctaggtacgaggccttggtgttaggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401243 - DNA, 2245 bp, Homo sapiens
acttaggctaggtacgaggccttggtgttaggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcacaaaaaaaaaaaaaaaaaaaaaaaaacaaaacacaaaaaaccaaaaaaaaaaaagaggggggggccacaaaaaaaacaccccagacgagagggggagcacaaaaaacaaagacaacccccgaaattttagggcaaacagggcgggcccccacatataggagggcgcgactaatacaaaaaccaagagaagagggccagcagaaaaacacaaaccgacgtgtacaggaggggaaaaaaactagcgggcacgagacgaaccctcaatatgagaaaagaagcaacaacacaaaggtggcgagcgaacaataacatcagaccgaaacgaccacaacaacgaaacaacagggatgataacaagcactgacggagagaaagcatacaacaacgcacgagcaacgacacctaaaaatgagtagaaacccacacaacgcagttgcacgacgcgaccgagaaagccagagacacaggcgaaaagtaagaaagagacaaaatataccacaagaggacagataaaaaagaaacaaaaataacaaagagaagacaaaagcagccaaaaacaccgacagaaaacgaagcgacagaagcacaccaccgaaataacagacaacaagagctaccaacaaacgcaggcacgagaacagaaaaaaggagcccaacaacagaccggcccaacacagacacgagaatacaacaacagaaaccaa

SEQ ID NO: 401244 - DNA, 2301 bp, Homo sapiens
acttaggctaggtacgaggccttggtgttaggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaacgaatgaaaaaactggaggcttatcttatgaaacaacatttgtggaacaaactactaattgtggcctcgttggcctacaagag

SEQ ID NO: 401245 - DNA, 2262 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacaaaaaaaaaaaaaaaatcattttaactcacattaccatgatctggagcattgttacatgttggatttgtgtgtgcactggtgtgtttatgcaagggagactggattcacaagtcagaggtgaatctgagcctcattaggcagaatattcaacccagcagaaaattgaatttgtcgcacaaagcacttaaacctacaacccattgcaagaattgaaatcagatcagggataagtgatatcagaatctgggaaagccggaggtgagggtggaggggaaaaagctgaaagtctcaaagcaagcatcgttttcaccttggtggggtgaaatttcaggacaggattttacctgaatgccacagctgaggaggaaggtcagttgcagctttaggcgatttaccagctttgagaaactagtcagtttaggaaatgattagggtattaaagctaaggtttaagataaagaaagaaaaggccacctagttgagatccaactggttggacttgggtttatgggaaagagagacagtggttatggttgctgtgggacaaggtctggaaacagattcctgagggacatagcagctggcagtgggcatagatggaaatcccaaatgcctctttcttctgacccctctgtcttaaacagggtagtgtggctgattttaggtcatgtgcctgatagcagtgcaagagaatatacaagaggtaattgggagataaaactctggtgcagttgttactgggggcactcatagtgtacacaggagaaaaatgtcatggaatgtttcattagctgcatccttggattagagaaaacacctttccagagcctccttcctcctgcccgttaggttacctgggcatcgactcccctgtctttgagatagtcagctccctgaggccaaggatgctggcttgagttggtttcttcacagcatttaacatagtgcctgacacataatagtctctctatttatgctaaataaatacaatcctcaagacttgacatcagctctggaatagtagagtgggaatgctgcagaaaagatccagagaggaaagaaggcaccgagatgttaaaatgcggcttgttgacagaatacttgggattgtccagtgctgctatttctatttttcacttttggcaggtatttattatttcactgataggagacatcaagttccagcattttaatcctgtacttgaaacctacatttacaagcacttcagcgccactttggcatatgtgtaagtatgatctgaaggaactacatgttgttggatctttggatttgtactcttaggactggattgttgagaaacgagacggacctattactattcagtaaatacgcctgttaaggcagaactcttattctaagcttccgggtggaaaaagggaaccatctaagtattctaactctggaaagggggctaagatcagggccttcattctggatcaggcgaaatttccttaaggatccagaataggccaggcgtggttgctcatacctgcaattccagcactttgtggggaggattgcttgaggccaggaattcaagaccagcctaggcaacataacaagaaccttattctttac

SEQ ID NO: 401246 - DNA, 2052 bp, Homo sapiens
cggcggtctgaggacccggtgtcgagataagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401247 - DNA, 806 bp, Homo sapiens
  misc_feature (665)..(665): n is a, c, g, or t
  misc_feature (669)..(670): n is a, c, g, or t
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaaaaaanaatnnaaaaatttccttgtcggccgccttgggccagtcgattctagactcggcaagcttatgatgccggccgaattgagcctactggccattcgcctttgggggtcgattacattatgggcgcggttaaacggcgggctgg

SEQ ID NO: 401248 - DNA, 2164 bp, Homo sapiens
acttaggctaggtacgaggccttggtgttaggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgcaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaatgcaagccatttcatggacatagcaatatacaaccaaactctgttccttggagttatattgtaaactcttgcaggtgggagagcagttcacctccttagctctgtttgccagctcttacagggtaaaataaacctggcaatttatcctcagtcctagtttgtggtttaatgttgctatcttaagcactggcatttgggcaaaacatgactgtgttctgtgggagaatccaaaggcattattcactctagttgagatagaattgggtggctaaacagggtgtgtggtacccaaaagattaaatgttacatgtccttttagtccttgaccaggtctagccttggcagaagcaagggagccactaagccaaactccctgtgcagacagaccatgtttcaaggctggaagtagtgccctggcaacacacaaaaggaacggtgaaatgtggtagcaactgcccttgctaatcaccgtaacctcggctgagaaagaagaggaagcgaaatccaagatgcagctcagttcatcaaagcctagcaggtcccctcagctgccttttcatgcctgccacagactacagtaggacaaaacctgacctggtctttgaagttaagagctaagaaagcttcctatagtagtatctcccatggcacttaccacattctatctggtattacaattatttgtatgcaattaatcactcttagattgtatgttcctggagggcagaatatgcccattcatatttgtatcttcttccttctgctcttggcacctaacacagtgccttgcacacaaacaataaatgattgttgagtgaataagtaaa

SEQ ID NO: 401249 - DNA, 522 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatctagcattaatgtaatcacattctaaatcagacaatgtaattagtcgac

SEQ ID NO: 401250 - DNA, 519 bp, Homo sapiens
gcaagggcctatcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaa

SEQ ID NO: 401251 - DNA, 988 bp, Homo sapiens
aaactatttgaaaaaattaacagacatagataaacctttgggcaaattagaattgtgtagaacttccttgagccaataaaacctacaacaacaatattttaagatgaagtatttgaagcagtccattagaatcaggaacaagtactatgttggagatcctagccagcattataaggcaagaaaaacaaaagattaaaggattctgaatatactattgatatggtttggatctgtgtccctacccaaatctcatgttgaattgtaatccccaatgttggaggtgaggcctggtgggagattggatcacgggaatgggtttctcattcgtggtttagtaccatcctcttggtactgtccttgaaatagttcttaggagatctggtaatttagaattgtgtggtacctctcccctctctcttgctcttgctccccctttgccttccaccatgattggaagcttcctgaagctgcctcagaagcagaagccactatgcttcctgtacagcttgcagaaccatgagccaattaaaccccttttctttataaattactcagtctccagtatttatagcaatgtgaaaacagataatatgactatcaatatacaaaagtgaattgcatttctttccagcagaaatgaactgttagaaaatgatttttgtaacataccatttactatattcctttaaaaatataaattaggtaacttaacaaaaggtatagaagacctctgtagaaaattacaaaactttattgacaggcatttaaaaatgtctaattttaaaattgccatgttcaatgattaaaagactcgagttaagatggcagttctccactacacaatgaaggtaattgcaatacaaatcccaaatgagtttttcaaggagcttgacaaactgattctaaagtctgtatgacaaaaagcagaattcaggatactccagaagcagatttaagatagaattgacttgtagatattcgtaacagc

SEQ ID NO: 401252 - DNA, 672 bp, Homo sapiens
tgcaggaaaagaaaactatttgaaaaaattaacagacatagataaacctttgggcaaattagaattgtgtagaacttccttgagccaataaaacctacaacaacaatattttaagatgaagtatttgaagcagtccattagaatcaggaacaagtactatgttggagatcctagccagcattataaggcaagaaaaacaaaagattaaaaattgtaaataaacataacttagtctacagataaattattgaagagctttgcaaggattctgaatatactattgatatggtttggatctgtgtccctacccaaatctcatgttgaattgtaatccccaatgttggaggtgaggcctggtgggagattggatcacgggaatgggtttctcattcgtggtttagtaccatcctcttggtactgtccttgaaatagttcttaggagatctggtaatttagaattgtgtggtacctctcccctctctcttgctcttgctccccctttgccttccaccatgattggaagcttcctgaagctgcctcagaagcagaagccactatgcttcctgtacagcttgcagaaccatgagccaattaaaccccttttctttataaattactcagtctccagtatttatagcaatgtgaaaacagataatatgactatcaatatac

SEQ ID NO: 401253 - DNA, 2609 bp, Homo sapiens
  misc_feature (659)..(659): n is a, c, g, or t
  misc_feature (1269)..(1269): n is a, c, g, or t
  misc_feature (1299)..(1299): n is a, c, g, or t
  misc_feature (1301)..(1301): n is a, c, g, or t
  misc_feature (1304)..(1304): n is a, c, g, or t
  misc_feature (1306)..(1306): n is a, c, g, or t
  misc_feature (1309)..(1309): n is a, c, g, or t
  misc_feature (1315)..(1315): n is a, c, g, or t
  misc_feature (1325)..(1325): n is a, c, g, or t
  misc_feature (1336)..(1336): n is a, c, g, or t
  misc_feature (1343)..(1344): n is a, c, g, or t
  misc_feature (1361)..(1361): n is a, c, g, or t
  misc_feature (1381)..(1381): n is a, c, g, or t
  misc_feature (1400)..(1400): n is a, c, g, or t
  misc_feature (1998)..(1998): n is a, c, g, or t
  misc_feature (2006)..(2006): n is a, c, g, or t
cccacgcgtccgctttttaaagcacttactgttttcagagcacccatatcccaccctggtgagaaggccactctcacatctgagtgttgggtacaaagctgctccgtagagtgatgtgcactcctggtgggtgaggggcaggggcagtggcagtgtgcaaagtgccgagattgcagcctctgcccggccgccaccccgtctgggaagtgaggagcgtctccgcctggccgcccatcgtctgggatgtgaggagcccctctgcctggctgcccagtctggaaagtgaggagcgtctctgcctggccgccatcccatctaggaagtgaggagcgcctcttcccggccgccatcacatctgggaagtgaggagcgtctctgcccggccgcccattgtctgagatgtggggagcacctctgccctgccgccccgtctgggatgtgaggagcatctctgcccggccgccccgtctgagaagtgaggagaccctctgcctggcaaccgccccgtctgagaagtgaggagcccctccgcccagcagccaccccgtctgggaagtgaggagcgtctccgcccggcagccacctcgtccgggagggaggtgggggggtcagccccccgcccggccagccgccccgtccgggagggaggtgggggggcngcccccataagcgctaacttaagggttgtggtattacgcctgatatgatttaacgtgccgatgaattactctcacgataactggtcagcaattctggcccatattggtaagcccgaagaactggatacttcggcacgtaatgccggggctctaacccgccgccgcgaaattcgtgatgctgcaactctgctacgtctggggctggcttacggccccggggggatgtcattacgtgaagtcactgcatgggctcagctccatgacgttgcaacattatctgacgtggctctcctgaagcggctgcggaatgccgccgactggtttggcatacttgccgcacaaacacttgctgtacgcgccgcagttacgggttgtacaagcggaaagagattgcgtcttgtcgatggaacagcaatcagtgcgcccgggggcggcagcgctgaatggcgactacatatgggatatgatcctcatacctgtcagttcactgattttgagctaaccgacagcagagacgctgaacggctggaccgatttgcgcaaacggcagacgagatacgcattgctgaccggggattcggttcgcgtcccgaatgtatccgctcacttncttttggagagctgatatatcgtcgggttnantgncnagnattgcnctgttaactncagaaggaatncgctttnncatgatggttttctccnggcggattgcggtaagaacngtgaaaccactgtaatganaggcaatcaggtaataaaaagccggagctccctttccggcacgtctcattgccgtatcacttcctcccgaaaaagcattaatcagtaaaacccgactgctcagcgagaatcgtcgaaaaggacgagtagttcaggcggaaacgctggaagcagcgggccatgtgctattgctaacatcattaccggaagatgaatattcagcagagcaagtggctgattgttaccgtctgcgatggcaaattgaactggcttttaagcggctcaaaagtttgctgcacctggatgctttgcgtgcaaaggaacctgaactcgcgaaagcgtggatatttgctaatctactcgccgcatttttaattgacgacataatccagccatcgctggatttcccccccagaagtgccggatccgaaaagaagaactaactcgttgtggagaataacaaaaatggtcatctggagcttacaggtggccattcgtgggacagtatccctgacagcctacaaaacgcaattgaagaacgcgaggcatcgtcttaacgaggcaccgaggcgtcgcattcttcagatggttcaacccttaagttagcgcttatggggcngccccccncctggccagccgccccgtccgggaggtgaggggcgcctctgcccggccgcccctactgggaagtgaggagcccctctgcccggccaccaccctgtctgggaggtgtaaccaacagctcattgagaacgggccatgatgacaatggcggttttgtggaatagaaagcggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagttgtgctttgttaaacagatgcttgaaggcagcatgctccttaagagtcatcaccactccctaatcgcaagtacccagggacacaaacactgcggaaggccgcagggtcctctgcctaggaaaaccagagacctttgttcacgtgtttatctgctgaccttccctccactattgtcctgtgaccctgccaaatccccctctgcgagaaacacccaagaatgatcaat

SEQ ID NO: 401254 - DNA, 986 bp, Homo sapiens
cagccgcccaagccgggctacagctactctatccgaaccagtttgttccttgacactttttacatgtttacgctctcaaaaattattgaggatcccaatatgtttatgtggctaatatctactgagttataccatactggcaactaacactgataattttaatatttatttaaaaatttcattttataatataactttttctttttccttttctttttattatttttttctttttttgagacggagtctcgctctgtcactcaggctggagtgcagtggcacaatctcggctcactgcaacccctgcctcctgggttcaaacaattcttgtgcctcagcctccatctcatgcctcctcagctggcactacaggcgccaccacacctggctaatttgtttgtatttttagtagagacggggtttcatcatgttggccagactggtcttgaactcctgacctcaggtgatccactcgcctcagcttcccaaagtgctgggattacagatgtgagccactgcgcccagccagtataacattttaataaaaataactagtttttttttaatgtacagaaagtggcattattttatacttttgcaaccctccctttaagacctggattagtagaagacaactgattttcacatttgcttctaaacgcaatctctcgccgtatcatatcatgtagcctctggaatactccgctgtacacctgagacagaatgaaagtggaaagggcaaataacgtgtttgtatggttacatatttttattttttccaatctgaatagcaatcagtttatattgttatgaaaacaagtttgatcttgggacgctctgtcttgaaagtcgtgggaatgcccaagcagccccagaccactttgagcactgctgaattaagaatatggtcatgtgacatcgggcacggtggctcacgcctgtcatcccagtactttgggaggccgaggtgggtggatcacctgagg

SEQ ID NO: 401255 - DNA, 318 bp, Homo sapiens
ctggcaaggccagccatatccctccaccatcctcagaatatgtcaaacctcagaaatatatcaattctccagctctatgtcacaatctagttcaagattaaaggatcttgagcatctttttcttccacagtatatcgcatgggtccgttgcacagagtgatgacattacatttactggacctagtgaatgtgaagtagcaactactctgaacttattggtaaaatatttgcagtgattggtcaggactaccttggggaaactggactactgctccacaatggagataagaaaaagaatgtcttaaatacaagaaatcc

SEQ ID NO: 401256 - DNA, 275 bp, Homo sapiens
atcaggaagggagcccagtgagcctgggttcttatccaccatgctgcattgctcccagataaatacaatttctacaaggctggcttgtcagctggagaaaaatctgacgtgagtttgtaatttaatgttccttagctctaaaatgacctagaaaaaatgtatacatttagtaattttgtgggcttgaatattttaactggacaacggcaatttatgtgatgcctatctattttatacccagataagtaaagaattcattactcctggtaaaagtt

SEQ ID NO: 401257 - DNA, 369 bp, Homo sapiens
gccaggaattcaaatagaatcaaatggtagaaagtaaaatcccctatttttcctcatgaactattcctgcatcctataggttaccactcttaacattttcatatgcattcatttcttcagaaatagtcacgtttggctgggtgtggtggctcacgcctgtaatcccaacactttgggaggccaaggcaggcagatcacctgagatcaggaatttgagaccagcctgaccaatatggtgaaaccctgtctctactaaaaatacaaaaattagctgggtgtggtggcgcatgcctgtaatccagctacttgggtggctgaggcaggacaatcgcttgcacctgggacatggaggttgcagtgagacgagct

SEQ ID NO: 401258 - DNA, 524 bp, Homo sapiens
gcagaaggagaactcctgaagcctccgaaggaaggaaatcattacagggccctacagaagtaggtcatgtgctacagctgctcatagtttaagaggaagaaacatgggatctcaaacctggaacacgactctttcaaaatgcttgtgagcaacccaagaaaaacatcctcctgaggcttatctaataaccatgatctctaatcgtctcaatgtgtgctcatgtttccttaggagtttgcacccacttctcagagctaacgagatgccgaaacagaacacagaaaaaagtaatgaaggagatttaatagtttgtgttaaagctaatatggtccattaggggctgtcatttttataaacagtgaggatacgttaccctcttctttggtgtaaagtcattccgtgcaggacctgtaaacattcagtaatgatctgtagaacatgcatgaacgacaattaaagcaccacttgaaaagtctgttttcctcacatatttgttttcttgctaaataaacttgtaaagttca

SEQ ID NO: 401259 - DNA, 743 bp, Homo sapiens
gcagaaggagaactcctgaagcctccgaaggaaggaaatcattacagggccctacagaagtaggtcatgtgctacagctgctcatagtttaagaggaagaaacatgggatctcaaacctggaacacgactctttcaaaatgcttgtgagcaacccaagaaaaacatcctcctgaggcttatctaataaccatgatctctaatcgtctcaatgtgtgctcatgtttccttaggagtttgcacccacttctcagagctaacgagatgccgaaacagaacacagaaaaaagtaatgaaggagatttaatagtttgtgttaaagctaatatggtccattaggggctgtcatttttataaacagtgaggatacgttaccctcttctttggtgtaaagtcattccgtgcaggacctgtaaacattcagtaatgatctgtagaacatgcatgaacgacaattaaagcaccacttgaaaagtctgttttcctcacatatttgttttcttgctaaataaacttgtaaagttcatacatgtgtacgcatatgcttacattataaaaaaagtgtgcatttcattaagaacatctacgaacagatataagtgtttttggttcccattagcttgagaaatatcagaagtgattagttaaatgaggagcataggttctgttttttagtgcatactataataataaaacaaccactcttttatggtagcttagcaagacaaaattatagttcacaatg

SEQ ID NO: 401260 - DNA, 533 bp, Homo sapiens
agttttatcatgcagatgaagcctctgggtggcaggcttctgagaggatagatgtaaatgcttcttatcagactaagtctgtgttgatgttaaggccagtgagggtttaatgagtatgtctgaaccccacttcccatcacggcctgaaccagcctcaggttaaattttaacagtgccctggatgagaaggaagtccattcagaaggttggggggccttagaattttatttttggtttacattcatagagaactgaccttgatctccttgggaactaaatgagacaggaacacttttctcaactgatcagcaagtatagtttggaagttggctgtgtgtacctagcacatgctgggagtggcagagacactagagaaagttttataaaatatacctgcaggaagctgggcatagtggtgcacacttgtagtcctagctattcgagaggctgaggcagcaggaggatctcttgagatcaggagtttgagtctagcctgggtaatgtagcaagaccatgtctctagaaaaaaaaaa

SEQ ID NO: 401261 - DNA, 693 bp, Homo sapiens
acctgtgctgttcttttgaatagatttcactttaaaggcaaactccagctattaagtagaagaaaatgtaaagaaagatgtttctacctgagtagaattgtgtggaccagaaacatttgagatcctctaaagtttggaaaattcctaagaagtggttctccagcctcttttttcctgcaaagcattatgatgtgatgggaaaagcatagggccagacagcatgaattcagatcctacttatcaggatactacttatcaggagctatcttctctgtattttgatttctttattgtaaggtgggactcacgccacatacttctgaggggtgtttttaacagctcatgtaaagttgcctagcacagtttctgatctatattatgtgctgggttaaagttaattctggtttacttactcttttctttcttactgttaatatcatatctggaagctaaatgtattatcagtgaaatttatcataacccagtagtttttaaaggctcaagtaaaagatagaaccagagaatgacttgagctctgagaagaatagatgttgaaattatgctgagaagatccctctaagtattttatgatcatcaaggctatgcaagttaagtcaatatttttatacagataaaggccaagaggacatttgagatagtagtcttttctgccttctaaatcaagaaaaaaaa

SEQ ID NO: 401262 - DNA, 1081 bp, Homo sapiens
gcgcggtggctcatgcctgtaattccagcactttgggaggccgaggcgggcggatcacgaggccaggagattgagaccatcctggctaacacagtgaaaccccgactctactaaaaatacaaaaataaaattagctgggcgtggtagcaggcgcctgtagtcccagctactcaggaggctgaggcgggagaatggcatgaacccgggaggcggagcttgcagtgagcggagattgcaccactgcactccagcctgggcgacagagtgaaactcctccatctcaaaaaagaaaaagaaaaaggaaaaaaaaaaagaagaatgttaacttcagcgctgtctataatagcaaaaaataggaaagaatctaaatccttaccaaaagaaaataatatattcatataatggattactacatagctgttaaaatgaataaattatataaattccaacatgaaagaagtttaaaaacctaatgttgaatggaaaacgttatacaacaaacatgataacatgaatgaatggttaaaaagcataaaacaatacaaacacatttatttaaaataaactggaaggatgtaccaggtccatgacggtgttacgtctggggaaggggagatggagggcgtggccaggtggtaatcaaagagtcctttagtttggaagcaaatatgactaccaatgctaacaattaacataagttaattctacatatagagaagatatgggtgtaggctgcctttgtacttttctatatttttccatttcttaaaaaaaaaaaaaacaaaactttaacaacttcaatgactgtgtaatattcgattgcacagttataccataatatactcaaccaatctctaattgttaagacaccgagatatctgccactatcataaactgtgctataatgaacatctgtgtagttatttttgcacatttttaaaaaaggataaattccagctgggttccgtggctcacgcctgtaatctcagtattttgggaagccaaggcgggcggatcacgaggtcaggagttcgagaccagcctggccaatatagtgaaactccgtctttactaataatac

SEQ ID NO: 401263 - DNA, 356 bp, Homo sapiens
gcctgcgggtctgactgcagcttcagctatgacctggagttcccgggcttctctgcggggcaccagtctgtatgctccattttagataataaaaattggcatattctggggtgggcaggatacggggttcacctgcagatgaacagggcaggaaaagcttgatggggtgtcgggggaatctggttggccttaaagggaatttggggtcctgttcctgaatttggtaggcagcatgcatgtaaggcttgaagtgggtttggccagagcatgggctggagtgcttccaccctgctacacggacaatgccacagtctcacttttcctaacttttttttttaataaaatgtgaacaccat

SEQ ID NO: 401264 - DNA, 462 bp, Homo sapiens
acaggcactcaacactagcccagtccatgagagcagccgtggggctaaaacttgcaaagccacaggtgcactgccctagtagaggttgtccatggggctgtgcctctgcagcaggcgactccccactcccagtgctttatcattcgtgaaggatcttcccgcaccattttatgactaaatttttttctacctaggccccacctctaatgttagggagtatagttccacatgagttttgatagggacatagagacaaaccctattattctatccctgaccccacaaacatcatgtccttctcacattgcaaaatacaatcatgccttgccagcaggagtcttaactcgtttcagcattaactaaaagttacaaagtccaaagtctcatctgagtcaaggctacagtctctttttcctatgagcctctgaaataaaaagcaagttcactgcttctaaggtacaa

SEQ ID NO: 401265 - DNA, 415 bp, Homo sapiens
gggcaacaagagcgaaactccatctcaaaaaaaaaaaaaaaaaaagaaacaacatgagcaaatatttgcagcaaatcaataaatggtccttttagactgaaacttggtatagcagtttaggattagtgagagctaggaccagaaagctaggttggctgccaccttggagtgagaacctcgaatgccaaggtgggcagcttatgctggtgtagtagagttccattttagtaacacagtcatctcttacagaactttcctctccagaggatgaggtatcaggttgttcagctttgagtgtgccatctaggtgctatcagctagcaccttcaggctctaatctgctcctggttggtttaataacagaaaaatctgccaacctcaggagttttttgtttgttttttttaaccaagaata

SEQ ID NO: 401266 - DNA, 453 bp, Homo sapiens
ctctgtcaggagggtgagccccggcagctgctgctcaggcccggcctgtggcttctgctgctgtagcttcccccatgggtccaagggcatccagggccctgcctgagagtggaggctcctcctccccttcatcctcagagtcatgaacaggctgtccaggaaacagaacatcctgcttcctgcaacttgggacacagggtctctgcactgaagtcctggactgaggtggcaggtacagctgtgtcgtcacagacccacctctgatgggaaacctgtgtctctgtcatcctccttttcccatttccaggagtttccagagtggtgtcttcctccccctgctcctcagtgtgaatccctgtgcttcctttctctccagccaattctttttttaataaaactcctttcatgtaggaataatgcatatttaataaaccacccagatttataatagga

SEQ ID NO: 401267 - DNA, 312 bp, Homo sapiens
  misc_feature (10)..(10): n is a, c, g, or t
  misc_feature (28)..(28): n is a, c, g, or t
ggaaagcacnccgacgatttttggaatncgcccccagccaccgcgacttccagcccggtgctccacccacctccaacatgtctaaatgcctccgagatgttctgtctgacctgttatgctttcaggaagctgtggccatatgtagactcttaatctggttctggtatctgagaacgcccctccaaggtgttcagatcagtttggcctccactgtgtccttccaaaccctttggcaaggcctgttttcagtacaagtttcccttggcttttgagaacagcttcatgactgcctccaagtaggaattctctaat

SEQ ID NO: 401268 - DNA, 391 bp, Homo sapiens
gcagtgtgctcccacctcaggaccttgcctctgcggcctccacttggaaagttctcagttccctccaggcttctagaagcatctgggccagggctcatggctggataatttccctaggcttaacaacccaagcaagcttcgcctcctcgttttattttttgttaaacttatgagaatgtattaagaaagagtgcagctcgagagacattcagagatggagcacaccagaccccagatcacaaagccaaccatgcccagcccctcccaacacccccagccccacgaccatcgttctgaattctgacgacaccgtgagcctgcctttgtactttaaactcatggaaggataaccaccttcacgttttgaaataaatgtttcctgttgaaatga

SEQ ID NO: 401269 - DNA, 317 bp, Homo sapiens
ttccctggtggttttagtactgaaactgcagtgctatttagctgagtttagatggcttggcacagatattttaggtcagcatttggattataaatttttcctctttgctcattggaatcactatcatctatgatataatttgctaattgttgaaacttgttagaccttaatcatataatattttacatttctttaagtgatgagcagtttccaaaaactggttagttaataatatatttgatccttaaaatattttgagaggccaggcatggtggctcacacctgtaattccaacattttgggaggccgaggtggga

SEQ ID NO: 401270 - DNA, 364 bp, Homo sapiens
gccttgtgctgccacacctaaaaaatggctcctgcacccatgtaagaagcaatctgctttctcagccatcttggctcacctgttctttgactaccccaccctgcctggggctccagtactgagtgtatctacagtgctatggggacacctaggagaactctaccagtctgagatgggcttgctgtgggtaagacagtgaaattcaaggaaggaatagaagacggtggagagaagaatagaaaaacactctggacagagaggaaagagcatgagtgagaaaaagcctgggagctttggggaaaataaaatagttttgaaggggctgaagctaaagtgtagacgagggcaagtagagggaagatta

SEQ ID NO: 401271 - DNA, 950 bp, Homo sapiens
gtgaaatcctcagtcccaaggccctcacgttgttggcttgaaagcgccctcagccaagtttctattctgtgtcttctccctcccctgctttttccatggcactcactggagtgcatgtcccgcaggcggccctgtggggcctcccatggccaggacatgcaagcttggaggagggctgggtctgcaccgcccagcagggtagtcctcactgtcccacgcagcagagtcccgcacgagggtctaactgggagtcctggggcagggcctgcgcttctcctctcatgtccacgatgctaggcacggggtctgcgcacaggaggatgagtggagacctggctcctggggctggcagcagaggaatagggccctcgacagccttcccatccccctccagtggctctgctggctgacccagaggccctgtaacccgttcctcctggcctgaggagcatgtgctgcagctgctctcattccctggctcgtcccctccagtgtcctgtgcacagtgaggcgtctgtgtcgaagagacccccttctctcacccactccggctccttgcctgggagcccactggagagctctggggctgcgtcccgactccctcaagcctggaactgggagagccctgtcttcatcagaggtccatccctgtcccaggggcaccagagctggggcctttgatggcagcccagcccatgtcacctcctgggccctggcctcacccctgaccccaggcctttgcccagaggagaggtggccgcccctccctggcccgtgtagcagtagcaggcactggctccagccttctggcatcttgcctagtccagccccatctagctcccaggctccactcctgagccccacccatagggccagtgtggcctgaggtcccaggacaatccctttagaccatgactgtggctcagtcccttaccctgtgacagtaatgg

SEQ ID NO: 401272 - DNA, 675 bp, Homo sapiens
ctttttaatctcatgtttgcagttgtacttaacacatgtaaaaatactaatatcttttaagccaaagtggctacagtggaaatcatttcagagatggatcccccaagtagaagctcaaccaaatgtattcatgtcccagtgagtcactcaagagacaacagagggaaaaaatacctttagcttatacacatgaaagatagttgagtcagtgtatttttatgaggactccaaagaaaatatatatacacatattatgatcaaaacatgtcttaaagaaaatattaattcagtgtgaagctgatctgtaatatctctacaagattagagcacctgagaccctcccagaatatcctccaacctagggaaaaataattccagttaaagctggaaatctcccctccatgttcatttgctcctctcatagcctatcttttatttttcaagcatcattttttttcattttgaatatctttagataagtcaaaacatgaaaaagctttaaaacctccagaacaataatttcatcataacacccatggtattctgtaatttgaagaatatctgaatattttgatattttttctcagtctggaatcttttggttgttctcctctctcctaaacttgaaaaacactcacctttttaaggtgcctgaggtgtgaatacaaaaaaatg

SEQ ID NO: 401273 - DNA, 457 bp, Homo sapiens
gtcccattcctcaagtgatttatacaagaacatttgcgtaatggaaggtaattttaatgtatgctaatttccatgaggcctgcactttcagattgttctttttgctggaggaatgactgaagtgtcccaagcatttgacttttcaccctcttgtgtgaacttctccgtgaatggttttgttaggaaaaaccacgctccaaatgttctgtggccattagaagagacctgttgtatgcatagcatcattctgctttccaagtaatttctatgcagatggtatacagcaaaatttttctgccttacattaaaatctgcatcaaccaataagaatgatttgctcctgagcagacacaaatgaaggattattgtgtgggaggagaagtacaagtacaaagtggatcaggacagcaggtgggaccaaaggaggatacaggtccttttaaaattcttaattaaa

SEQ ID NO: 401274 - DNA, 434 bp, Homo sapiens
agatggggggaaacagaacatggcaaagaatgactggactctaaaaagttttatattctggattagtcagaatttcaacagaaaacagttggtaaatacaactaagaataatttgaggaatgcttccatacaaaggaaggagcatgaaagaattgtaagcaataaatctggaactggcgctcagtgaggataaaaacaaaacatggaaaaagaaggagtagaagatcagaccacctggagaacaaaagtgaccttctgtaaagagacacatgtagggaagacagcctcatggggaagagaccaacagaataaacaccatgacccttttctcctcttcctttctgccttcttacagggttctccacaggctgaacctaacctgaagccagaggatgagggagcctcctaatgtattcgtgagaagtcaaaaaaaa

SEQ ID NO: 401275 - DNA, 444 bp, Homo sapiens
tgagtccttccttattatgcccttggaagatgctttgaggaccccagtgatgaatcccaagaactctgtctccattatccctggtatagggcacctcatcactccggtgttatccctgaagggccttcataataatgtgcttaaagagtcccctattatgtccttcaggatggagcttgacttgcccaaattgctatgtacatgttaaagagaggctggaactgaagttggtcatttctcactggatcagtcaacaagatttgagtactttctgtgtgctctgcatcattctgagtactctggaggacagaataaggcatggctcctgccttcaaggagtatggaatttaatagaagatgacaacatacatgattgtaaatctatctacatgagagtgcctaattgtgagattcctaataaatggcaagatatgttctgaaaat

SEQ ID NO: 401276 - DNA, 193 bp, Homo sapiens
cttaagggtctccaagagcatgtcctgcttgctgaactaatttcctgatcaattgggttatttgtctggtagattggagcaaacctggaagctcatgattctagggctctgctaagtctttccatttatttttgtgggtgcagcagtgagatgtgagctgaatgatggtgtggtcagaggcttcctgagtgga

SEQ ID NO: 401277 - DNA, 363 bp, Homo sapiens
cgttcttcaaatatgtggcctgcttcaagataatgtaactgcacatcagctaaatgattataaagcagctggtgcctcccaagacggagcccccgcaacggcagtgattttgacaggcagagataagggtgtttccataataatgtggtagattaagggattcagcctgctgtactgaggggagactaaaatgcatctgaatttttatttggagagatctgaatgtattttactaacaagtctggtccttttgggctgaactttccatttgtcatggaagtgcccggcaatatcttgactccgatgttgtaggaagaccagcttcccggtgacgggattagctcagtcacgggagtaccagcc

SEQ ID NO: 401278 - DNA, 474 bp, Homo sapiens
atcaatgtatcaaagagatagctgcactcccatctttattgaagcactattcacaatatccaaaatacagattcaagcagtgtccatcaatgaatgagtgaatcaagaaaatgtgctacatatacccaatggaatattattcaaccataaaaaagaatgaaatcctgtcatctgtagtaacatggatggaaatgggaggtcattatgttaagtgaaataagccaaacaaagaaaaacaaatatcgcatgatctcatttatatgtgggagctaaaaaagtagaactcatgaagatagagagtagactgatggttaccagaggctgggaagggaagggagtagacaaggataaaaggaaataaaagaatatgaatgtatttattaccactaaactgtacccgtagaaatggtaaagatagtaaattatatgtatgtatacatatatatccttaataaaaaataaaaaataaatatt

SEQ ID NO: 401279 - DNA, 408 bp, Homo sapiens
tggattttactgtgcgaagttgaagaagcaaaagaatattgcttggtattgatctttcctaagaaaacagaggtaaattatgatgtattaataagtttacagtaaaattctatgaaagatgaagtacttaaaatagggaaaaagaaaagatgataaaatagtaaaacagagctgaataagacacagaaaaaaatgtaaaaaattagaaatgccatggataaaagcagccttacagaagccaaaatacatcggaaggtttcatctaagatatgaaattaaccaatttactacaactaccagaatgcactgaaataagacagagatgaaaactgcaagagaaactatgataggctatttgacatcactgaaaaagagactgcaaaaaaaataaatatatttttaaatata

SEQ ID NO: 401280 - DNA, 447 bp, Homo sapiens
catgaaaaactcattaccatttgatgctcctgattctacacaagaaggccagaaagtccttaaagttgaagtcactccaacagtgccgaggatttctcggactgcaattacaacagcttcaatccgtcgtcatagatggagaagagaaggtgagtacaaaatccccatagtccacacatggagtcaagtaaatttatcactgtttttacagactgtcttagcacgtgatattaaaagaccctgtataattaaagtaattttttttgttaaaaatatcactagaaatgtgactaaatgtctaaagttattttaatatgtatttataaaatagatgtttagattgctgtataaagattaaaacaaaataagatgaggttaaattttgtctttttttgaactaaataagaacaataggaaagaagttgctttaaccttgttaccatactg

SEQ ID NO: 401281 - DNA, 495 bp, Homo sapiens
cttgatagtgtcatttatagcacaaaagttttaattttgatgaagtcaaagactctatctacctaacccaaccaagctcatgaaaatttactccaatatttttatctaagagttttataggtttagtgcttacatctaaatttatgattcattttagttaatttttgtatatgatgagatccaacttcattcttttccatgtggatatcaagttgccccaacactgtttgttgaaaagatgattctttatcctgttgaatagttttggcaccctagtcaaaaatcataaatataagggtttagttctagattctcaattctattccattgacctggatgtctatttttatgtcaataccacactgccttgattactgtagctttctaggaggtaaatcagtaagaatgggtcctctaactttgttttagctattctaggtctcttgcatttctatataaattttaggatcaacttgtcagtttctgaaaaaaaaa

SEQ ID NO: 401282 - DNA, 1699 bp, Homo sapiens
  misc_feature (786)..(786): n is a, c, g, or t
  misc_feature (864)..(864): n is a, c, g, or t
  misc_feature (1168)..(1168): n is a, c, g, or t
ccactgatgacttgtagatggaggggtacatatgaaaagggcttcagagtggcctccaggagttaggagcaaccaccagtcaacagccagccagaaacagaggtcttggtcatctaagcacaagaaattgtattctgccaacaagaagatttggctgaccatgagaatgatttttttcctagagcttccagatgaggactcagtcatcagacacccagattatagccctgtggtaccctagttaaagaactaagctattccatgtcagagttttgaccaacagtactgtaggctaataaataggtgtgactgtaggctgttaagtttgtgtccatttgctatgaagcaatagaaaacaggcaacatgctctgttttttctactcttgcatcaccttggtctttctgttctcctccattcattaataaattgcttctggttcctctaggtactaggctgtgggtaggggaaggtaggaaagttgagaagaaagttggggtgtttttaaaatgacttaagttcagctgtcttccgagttcatgggaaaataagccattctttttctgccaaacggtggtattaaggcttgcaggatgaaatattttgcttctgacttctccagctgagaagcaggcataattttctgtgattattaatattgcaaactctagaaaatgcaagctagccttcccagaagttttctcactgttctacactccaattgccctaagggaaatagagggtgaagactgtctttccttctcagaggcactcccaatttctatgngtgattctcttgggtcaccctcatgtcaccagggaatgaaatattccccatcttactccatgcagaaaggaggagaanagccaggacatgttctgtattcctatgtattcccattaaccactagctttctcttacatatgttcattaggggatgaacaagaatattggaaagattggtaaaatcttgtagggacatttctagatgatttctatgattgtttgggatatttgcaatctgtccttagttttgattcctctgtgaattgaggtaaaattcccatttaaaatcctgttgcaaattctactttgcgaaagtaaaaaccaccaccctgtgctctatgaaagttcctttcttgcctactgataatagtttggttctctngagttaaaatatagctttattttcagatatttaaaatatctgctttttattttctaaaaatcactctaactacttggtggagagtagaatgcaggaggatgaaattggaccctgcaatacagatactcttgaggtaatctagaccttccattaaatgggtgatccatggaatggcaggatcaatgtcatctggaagcctgtaagaaaagatgagtctctggtctttcttcagacctactaaagtagaatgtacactttaacaagatccccaggtaatttgtatgcttactagaaattgtgaaggacttctctaggtgagatttgatgcttgcttatctagggtgatgtgtgtggaaatggggataagggaatggatacaagatatatttttgagatacaaatgacagaattttaggatgacttgatgtcagaaataaggaaaaggaagaaatccagcatgataagttaggtttctagcttgagtaacatagtggtggtttatgaagtttgggagaggaatatgcttgatac

SEQ ID NO: 401283 - DNA, 536 bp, Homo sapiens
tgaacttgttgccctgttcagcccagaggctgtccctatactgacagcagatttcttgctttgaattatctgtgtaataaaagagtccttccgagcttcaactgacattctgaggctgagagaggaagatccatttttttccccatctaattctttctttcactttttttttctgatgatgaaaaattttttttttggtttgcattttggaggattttcttaatgtgctgcatacagctctcggcttgtggtccactgcgggctgtctctcctcagactggaatgattaggcagtgaaagagacttaccttttccaaggagtacctctgtttcagaattcagggtggagcatgctggcaaccttttgggggcactttagatatgaatgagtttgaaggcgtagctatgatcctttcagaggccatttagtgccaaactgtatcctgtgattcatgtgtatatccatctgattaaagacaagacgggtgataaagagaaaataaaagaaaatgaagaagaaataaaagaagtgtgaa

SEQ ID NO: 401284 - DNA, 443 bp, Homo sapiens
tataggctgggtgcagtgcttcatgcctgtaatccgaacaatttgggaggccaaggtgggaggatcacttgaggccaggagtttgaaccagcctggccaactgagtaagagactatctctacaaggaaaataaatctactttaaaaattcgtaattaatggtcaggcatggtggttcatgcttgtaatcccagcactttgggaggccgaggtgggcggatcacttgaagtccggagttcgaggccagcctggccaacatggtgaaatcctgtctctactgaaaatacaaaaatattagccgggcatggtgtaccgtgcctgtagtcccaactacttgggaggccgaggcaggaaagttgcttgaacctgggaggcagagtttgtagtgagccgagactgcaccactgtactccagtctgggaaaaagggcaagactccatctc

SEQ ID NO: 401285 - DNA, 527 bp, Homo sapiens
gaaacaaagttgcagtgggctaaggaaatggctacagacggtaaagtaactcttaaaaaaatgtattgttggattatgtcaatatatgtaatatatataacaataatatacaaaggggggatgggaactgaactatatagcagtaaagttcaataaattttagcatgtattactgaaactaagcaagtataaatctgaatttgattctagcaagatacatagggtaagctctagaacaatgactttgaaaaaatatatagtggaaaaaattactaatgaatttagaatccttctagtaactggccactgaataagaaaagaaaaaaatttgaatgctatattagaaaatatcctctcattgcaaaagaaagcacaaaggagaaatagagaaaaatgacatgagacatacaaaaaacaaaaagtaaaatgtaactctatcaataattacattaaaatgtgaatggatcaaacaatccaacaaaaaggtagcttgtcaaagtggattttaaaaacatgatctaactctg

SEQ ID NO: 401286 - DNA, 371 bp, Homo sapiens
atgcttactgaggagctactgtgtccctgaaattgcctccacctccaagaagacagtggtgagcaagtcagacaatacctctaatctcatggtatttataagtaaatgggccgttaaaattaccagatcagaagtgctgtgttcagcaaatagaggctcatgggaaactcctaagaagggcttctgagctggacttgggggtcaggaaaggcagaatgagggggctgactcatccagactggggcggggttggcgggggtgcctcccacttactatctgtctccttctagactgacttctctgtcatcatgaatacacccctttaagacatacatttaagagaaaataagaggatgccttatttatttaaa

SEQ ID NO: 401287 - DNA, 84 bp, Homo sapiens
tttcaggccaaaagtgaattatttttagattatcatattagaaaataggaagtgctttgttgggttttatggcctactctaatg

SEQ ID NO: 401288 - DNA, 362 bp, Homo sapiens
gcagaggacccagctcccccgaaccctgactcgtgacccacaggagctgtgagataaagagggtgtggtttcaagccacagcagttttgctaatactgtcatgtagcaacgggttatagatccaaatggaataaaaaaccacaaacatcctagaaggaaacacagaagaatatcttctcagtctctgggttagcaaaggtttcttaggccacagaaagcattaagcaaatctaattttaattaaaaactagatttcataaaaatgtaaaatttctgttcattaaaggatgccatgatgacaccaataagcaacccatagattaggggaaatactgcaatacctgtctagagctgagaataca

SEQ ID NO: 401289 - DNA, 164 bp, Homo sapiens
ctgtatttccagacaagatttacctaacatttagcctgctcaggagatgcaaaacaatataagtttctgttaaatctgggttacttcattggacagacaccagaaccaataaacttctaaaataggagagcaccttgttgcttagttttggtgtcaggtgttcc

SEQ ID NO: 401290 - DNA, 544 bp, Homo sapiens
aggcacaaaggtgcagctattaggaaattgcatataatataacttaattttgcacaaaaatagaagtgtccactgcactaagttatcaatgctcagatttactgttttgcaacacctcagcaaccaaatatttcaactgcattctacttgctatttaaaaagttaaatttttactccatgaacactcaagaaatatggatgaatagtcgtagagtagttctgttctaacagtcttggctgaatgaagctttatctgttattcttctgaaactctaaacccaaaacaaatgaaactctgcttttcaaatctttattatataatgcaataaaaataatctgtacaggaacatgaagagaattacactggacatgctcacctgagacattagattttgtaactgtatataaagttaattttttaattagttacataaaggatgtattttaggattggtcacaaactctgattaattgaatacttctgaaaactatggaaactgaatataaataaatctttttagttcctgagaatctaattctcaag

SEQ ID NO: 401291 - DNA, 366 bp, Homo sapiens
tccaagataagctagaaaatggcttttagaggaaaaacattcaaatatactatatttgagttgaaatgtaatttttatgtgaagtctttcagattatacatgtcagctatttcagtgcagtggtttacacctgtaatcccagcaatttgggaggctgaggtgggaggattgcttgagtccaggagctcaagaccagcctgggcaacatagcaagatctcaactctacaaaaattaaaaataaaattagggcccagtgtggtggctcacacttgtgatcccagcactttgggaggctgaggtgagaggatcacttgacgccaggaatgtgagaccagtctgggcgacatagtgagacctcctctcta

SEQ ID NO: 401292 - DNA, 539 bp, Homo sapiens
ccagatggatgggtggcggcagagatgctcctcacttcccagactatgggcggccgggcagaggtgcacctctgccccaccgccctgtctgggaagcgaggagcgcctctacccagccgccccatctgggaggtgtacccaacatctccgaagagacagcaaccatcaagaatggtgccatgatgacgatgttggttttgtgccaaagaaaagggggaaatgtggggaaaagaaagagagatcagactgttactgtgtctgtgtagaaagaagtagacataggagactccattttgttctgtacttagaaaattcttctgccttggtatgctgttaatctataactttacccccaaccacgtgctctctgaaacatgtgctgtgtcaactcagggttaaatgtattaagggtggtgcaagatgtgctttgttaaacagatgcttgaaggcagcatgctggttaggagtcatcaccactccctaatctcaagtacccagggacacaaacactgcctaggaaaaccagagacctttgttca

SEQ ID NO: 401293 - DNA, 445 bp, Homo sapiens
atatagttatttttaaccagaaatgaaagtaggctttttggcaggcctatgtgttcacatctgtgctgggtttatatgttcttgccaacagtgtacttagtggtataacagagaaaaatgattcataagctttttcaaattcagacctacgactcatttatacttatattcccattaatatcgttagtatgaatggctttatatagttttctaggactccctcattgtaagttgagagagagggtagtctcgtcataggaagcatttctttgatggtatccatatattgagttgcatacattgtatgaaatgtaaagccttagcagatgcctaaaaatggttatttaatgaggccatttatgtccctcgtttctcaggttggaagattctgctggactacttagaaccccaactttattcatagtctgttgagatctctgttaaa

SEQ ID NO: 401294 - DNA, 478 bp, Homo sapiens
gaaaaccactgagtcaagacacattgtacagctccaagattccttctgtgccgttttcccccagcatgatatatatatttggcaaagagaattgacatgacccaatactcttgagactggatcaggccattccaagtttattacaagaaatttatactagaattacttaatgagataaaatttctccactgtgccacttgaagctgcgagaataacactggctttgggtgatgtgcttctgcccaaactggatgggtggacgtgctctatttgccgtataagttagtgagctacattgtagagttaggatgtaaagaaattgataagctgttgttagttgtctctaagaaaaacctgctaaagaaatacgcaggctgccgctgtttgggctccagacgcagaaaaagaaaaacccaaagggttttcctttcctctcatcctttaaaattaaaaatacttccccttcctctctcttatt

SEQ ID NO: 401295 - DNA, 878 bp, Homo sapiens
aatgatgatttcatacaaaggacagagaacacacagttggctgtctagtgtaccggtggctgttctttggaagaattctcatatgtgtcgagggaagaatcactattaaatgaagcattttggctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtactcaaaaaaaaaaaaaaaaaaaaaaaaaaaaagaaaaaaaaaactggctcggcgcgcgcgcacctgaggcccctcgaaaaaggcttctcaaaacaatccggtggggcacccgggggcccacgagggcaacgcagaacctgggcacaacgcgggtcccaaggaagatccgggccagaacaagggcccgggattcccacccaataaaaaagcgccggggggaaccacgagcggtctggaacaaatcccaaggggagtacagaaaggcactaagggggagctcaccagagagatccccaagggagcccaatataattgc

SEQ ID NO: 401296 - DNA, 564 bp, Homo sapiens
aatgatgatttcatacaaaggacagagaacacacagttggctgtctagtgtaccggtggctgttctttggaagaattctcatatgtgtcgagggaagaatcactattaaatgaagcattttggctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtact

SEQ ID NO: 401297 - DNA, 591 bp, Homo sapiens
cacagtggctcatggctgtaataccagcccttttggaggccgaggcagatggatcacttgaggtcaggagtttgagaccagcctggccaacgtagtgaaaccccatctccactgaaaatataaaattgtagctggccgtggtggcgcacacctgtaatcccagctacttaggaggctgaggcacgagaatcgtttgaacctgggagacagaggttgtactgagccgagaacgcacccctgcagcctgggcaacaaagtaagactctgtctcaaaaaaaaaaaaaaaaaaaagaataattagaaatgggtgtttagaaagggtgtaaatccatcataattattggaggaatcactcactctacccccaaaatgctggtgggaaaatgtaagaacattgttccacatccatatagcatgctaaataccaagtaaataattacatgtgaaattaggattttaggattagtcctataattgttttcagactacaaaatatgacacagtattttacaatatttcttttcaatttgtttttggttcatagtacacaggatgtttttacatttactttactgttctcacatccccatc

SEQ ID NO: 401298 - DNA, 490 bp, Homo sapiens
actgtcatatcagcgctggggttgaatgtcggtgcgagtctgctctctccaggaatcaaataaaaggcactgaaagcaactattttccttctcaaatggaaatgtcatctcaatgttaattccttataatcctagaagtagacatacagtattattgtgcctatgttatagatgatgaaagtgggctcagagaactgacttgcccaagatcataggaagatgaaataaaatctgaagtgtccatcctagtgtcaagtggtaggtgctgaccaaatttaagttcaaaaatgaaaacaagtatctaactcatccataaagaagtggaaatggaggaccatgaaacttgccaggggctgagctaggaccagaacctggggccctaagcctcgtggccctggcgtctctgagccagacctgtaggtatgagctgccaggatccaggtgtgactcgggtatttctagggtgaaacctaggatttcgaaactgaga

SEQ ID NO: 401299 - DNA, 513 bp, Homo sapiens
ggataatatgggaacattatgaacaattttatgctagcaaatttaataatttagatgaaatggataaatatcctgaaagactcatattactagagacttcttaagaaaaaatagataaactcattagcttgtgtccattacaattgaatttgtagttaaaaatattctcacaaagaaaactccaggcccagatggctttactggtgaattctgctacatatttaagggagaaaaaaaaataattctatatgaattcttccagaaaatgaaagaataagatatacttccaaaataattgtggaggtctggctttatgctgacagcaaatacagacaaattacaataatgtaatgtagtaaacataggagtgaaaatgataagcaaatttaacaaagtgaatccaacaacctaagaaaggcataatatacatcatgattaagggagatttatctcaggaatgccatgctcattcaacatttgaaaatcaactggtttgccatattaaccaaataa

SEQ ID NO: 401300 - DNA, 440 bp, Homo sapiens
acagccttagcaagctgccccaccagtctgaccagatagattgccctggggctgaaccctgcctctgcagggctggggtgaagggtgtgtggtcgtgggaatggcgctggcagtggcggtgaagggcctggtgtatgcaggctcagccttcttggaagtgagcaatgattgagggtgaaagaggacaacatgaaaaaaagcaataaaaggaaaagcagagacagacacgtgggggttttgcctttgctgcttatataattgcttttgtcataaatctgatgcatggaagtatgggtgggcatacgaaatgcagctgatcactctccaggatttggtattcttactgctttttacacagggtaaaaaatcaccttaagcatcaaggttatgaccatagcccaaccccatgactgatctcatgccctactcattcactctca

SEQ ID NO: 401301 - DNA, 524 bp, Homo sapiens
tagtaatcataaaagagcagtcgtctatctggatgaaattcagagagcatgtattattttgttttgtatttagcttcactggtcattgagttgtacataatcagattcttaaataattttaccttgagatttaaaatgacagtgtttcagcagccgtctactcttttttatttttcagacaagcaatgaacttttcctaacatctaattgattatgctatcatctcttctgttcttatacttaccttgttacaacctcttcagcagatgtcttgatcttggcttgttagggagattaggtattaataacctgatgtccataggcaaccatgtctgtgatctactgggagtgtataggagagagagagagtgtgtgtgtgtgtgtgtgtgtgtgtgtgtgttttccagtaagttttccttagtttctcaaaggcagtgttaggccctcctccaccctgcagaaagttaagaatcgctgtgatgcaatgtgaatgtactttcagataaggctgaagtgtgttattc

SEQ ID NO: 401302 - DNA, 532 bp, Homo sapiens
atcatgatatttcattctgatgttcatactcctacagagtttccatgctcataatctagtttagagcctgacaccttcctcccacactggaaaaactctagccccccgccccccttgaatcctgaaaaagaaaaggaaggcaagttgtattctcacccttgggccttctgcccacatcccctgttctggtattggtgacccaggcacacatcaagttcttgagacaactgcggaatcatagcctgagggctgaacagctgcttggctgcctgcgctcagtcagtttggctttgaagaccctgccttaaaaacagagaggttgtggatgggggaactctgcgcagaccaaccccagcaggggagtagagagcccacctgagcctcatcccaccttcactgatcacaggctgcagggcctcaaagaggcggctcagcatttctgaacctcatttttctcacctgtagccccaggatagttagatctatttacagggctgttgtgagatttaaataaattcacacatcaagccta

SEQ ID NO: 401303 - DNA, 364 bp, Homo sapiens
agaatgttccagagggagccaagtgagccaaagctgggagctgcggaagagccagatgcattcagtgaaccaaagctttccatggtcaaccctggggaatgctgcaggctcaagacaaggcatctagaatgacctctagtgttcctttaccactgccagtgtatgattcttcctcatgagcctgagtaggaatgtttcatatgggaagtgggtaggtggcggggtgcagcagctcacacctgtaatcccagcactttgggaggctgaggtgggaagattgctcgaagccaggagttcaataccagcctgggcaacacagcaagaccccgactctattaaatttaaaaaggaaaaaatgaagtgg

SEQ ID NO: 401304 - DNA, 366 bp, Homo sapiens
gttttcaggcaagcctcactttccagagtgcccttggaatcactgctatcatcagttggaattagttctttaattaaatcctggccatcgatcagcatccctttctatggcatttgacggagcttacagaatctgtgttgtaaacaaagcagaagcatcttatttcccagaactgtggtttattaacacctaaggaaactggttgtctgatactcatatttttaaaaaatgtgcttagtaattcataatcttttagtccttctagactgtcagcattgttggatatgctttatatatacttttgttatatgcttatttgtaagtttctttttcttaaatcgagaatctatgtgttcgtattttgtc

SEQ ID NO: 401305 - DNA, 366 bp, Homo sapiens
gagccaccacgcctggctaatttttgtattttagtagagatggggtttcactatgttggtgaggctggtctagaactcttgaccttaggcgatccacctgccttggcctcccaaagtgctgggattacaggcatgagccaccacacccggccatgagtacatgggttaacccttgtccaccccagggacccaactccccactgtgcttggaaatgggaaataaagcaggaagagtccctgttatttaccggtggcaagactctggccagaattgttaagcaagagcaaaattggctgctttggatattcgttccttcctttggagatggtgccttcaggaaaattatcagaacttgcatagaagag

SEQ ID NO: 401306 - DNA, 632 bp, Homo sapiens
  misc_feature (602)..(602): n is a, c, g, or t
ccgggttcacaccattctcctgcctcagcctcccgagtagctgggactacaggcgcccaccaccacgcccagctaatttttttttgtatttttagtagagacggggtttcaccgtgtttgccaggatggtctcgatctcctgacctcgtgatccacccgcctcggcctcccaaagtgctaggattacaggcgtgagccaccgtgcccggccgattgtagctcatttttaagggagtaattaatttaacaatgtagtgcagtgacatttttatatttgtaatctgtgctgattattgtaattgaattttcaacatggcaaagtcttatcaagttttgatatatttttgtttttatacagttggatccttatgactatgaaatgattgaagttgtcttgaaagttatagaacgagctgatgaaaagataaccaatattaatattaatcaggtataacaaatatatcaaagatgtaaaaatcatctttctgcttttatttggatcataaatcatatcattatccagggcctttccaaattatccattgaattccctttaaactctgtggtttattttaggtttttaaaaatctttacaaatcttntaaggtgttttgaggtgatttcctctcctt

SEQ ID NO: 401307 - DNA, 714 bp, Homo sapiens
ggatgtggcgagctagtgattaaaaaaaacttttttttttatttgagccgagattgtgccacttcactgcagcctgggtgacagtgagactccagctcaaaaaaataaagtaaaataatataaacatgcctgtaatcccatctattcaggatgctgaggtggcaggattgcttgagcccaggaattcaagtccagcctgagcacatagtgagatcccatctcaaaaaaacaaataaaacaaacaagagtgaaaaatagttatttctacgtgtagtgattatctgaggagggtcctataggaagctacatggctctgaggaagatgtcgggagttctagggtctgagataagaaggaaatgtactttgcattgtgtgatctttggaactgggttttttttagttttttgtttttacctttatgaagaagaaaactaattaaaatgcatttaaagataatccacttaaaaggtataaccttaattttttttaaaactgacttttttcccttctttgtctattcagtggcagttcttggattgaatttctaaataatgaagatgatcttaaagatatttttttacagctaaaagaaggaaaccttgtttgtgcacagtatctttggcttcgacatcgggtaacatgttttacattttttccttaacagctttatagctcctgagttaggtgattgaatcaatgttggagactaacaa

SEQ ID NO: 401308 - DNA, 711 bp, Homo sapiens
tggtctcaggaatggaaacttttgatggtatactattagatgattttatgacagtttaggattgggttactcttactggacaaaagttttttattttaatataggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaaggtaatggattaaaacattgtaagacatttctgtatcctgcaattaattctgaccccgtatagaagatttttctgctgctttcatgtaaaaccttatatgtgaatatgtgcttcagccataaccttccttttctttgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggtatgagctcttcttttaaa

SEQ ID NO: 401309 - DNA, 4975 bp, Homo sapiens
ttcccttttggggtctttgctcttgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401310 - DNA, 2596 bp, Homo sapiens
ccgggttcacaccattctcctgcctcagcctcccgagtagctgggactacaggcgcccaccaccacgcccagctaatttttttttgtatttttagtagagacggggtttcaccgtgtttgccaggatggtctcgatctcctgacctcgtgatccacccgcctcggcctcccaaagtgctaggattacaggcgtgagccaccgtgcccggccgattgtagctcatttttaagggagtaattaatttaacaatgtagtgcagtgacatttttatatttgtaatctgtgctgattattgtaattgaattttcaacatggcaaagtcttatcaagttttgatatatttttgtttttatacagttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401311 - DNA, 4897 bp, Homo sapiens
ttcccttttggggtctttgctcttgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaacagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401312 - DNA, 1362 bp, Homo sapiens
  misc_feature (67)..(67): n is a, c, g, or t
  misc_feature (85)..(85): n is a, c, g, or t
aattatgtaatcaatataatgtaatagtattagaagaaagggggggagggctttgtgagccaccagnattatttgttcttgaggnaaaacgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401313 - DNA, 1226 bp, Homo sapiens
  misc_feature (31)..(31): n is a, c, g, or t
taactccgtagtcaccctcttgttgtacagncccagggcgatgatctacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401314 - DNA, 819 bp, Homo sapiens
attacaggtgtgagccaccgcacccggccgagatttcctgttttacaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401315 - DNA, 4884 bp, Homo sapiens
ttcccttttggggtctttgctcttgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401316 - DNA, 4407 bp, Homo sapiens
ttcccttttggggtctttgctcttgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagcaaagaagataaagaagtttgtacaaagcaactttttataaatggatggctgtcaggcaaaaataaatttcctgtggacaagaccaagagcaaggcaagaggaaaataaacatgtttaaact

SEQ ID NO: 401317 - DNA, 3320 bp, Homo sapiens
ttcccttttggggtctttgctcttgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgtaacaaggaaataactaagatcacgcagaccatcgaatcctgcttactctctatagtcaacccagagtgggctgtagctattgccatcagctgcagattctgaggtcttaattgttattcttataagcatctagaagaacgttaattccgatgcatgtcatctataggcaccttgctacttatgatcgtcctatccaatatgctgagtcacgactc

SEQ ID NO: 401318 - DNA, 6965 bp, Homo sapiens
ggcatggaacctaaagactagaggcggttgtgtgagtcaggaagaggggccagatatctgagtgttcctctttagtttcttcaattgcagataatatggtgtctaattttatgttgttcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttctgaaaaggcctcattaaatccaaagatacaggcatgcagcttaagtgatgggtttattattgtagccgaccaatcagtgatattgcttgacagtatttgtagatcacttcaattgcatcttgtctttgatactgaagtggatgtagttggcctttgtcaagaaggaaagtttcttttggttggcgagagaagtggcaacctacatcttattcatgtaacatcaaaacaaacactactcactaatgcatttgttcagaaagctaacgatgaaaatcggcggacttaccagaatcttgtcattgagaaggatggttcaaatgaaggtacctattatatgctacttcttacatacagtggatttttttgtattacaaaccttcagcttttaaaaattcaacaagcaattgagaatgtagacttcagtacagcaaaaaagttacaaggacaaatcaagtccagttttatttctactgaaaattatcatactcttggttgtctcagtcttgtggctggagatttagcaagtgaagttcctgtgataattgggggaaccggtaattgtgcattctcaaaatgggaaccagattcttccaagaaaggaatgacagttaagaaccttattgatgcagagattattaaaggtgcaaagaagttccagctgatagacaatctactttttgttcttgatactgataacgtgctgagtttatgggatatttacactctaactcctgtatggaactggccctctcttcacgtagaagagtttcttcttactacagaagcagactctccttcatcagtcacgtggcaaggaattacaaatctcaaattaatagctctgacagcttcagctaataagaagatgaaaaacctcatggtttattcattacctacaatggaaatactatattctttggaagtatctagtgtttcttctctggtccaaacaggaattagcacagataccatataccttttagaaggagtttgcaaaaatgatccaaaattgtctgaagactcagtctctgtgttagtactcagatgtcttacggaagctttaccagaaaacagattgagtcggttacttcacaaacacagatttgctgaagctgagagttttgccattcagtttggactagatgttgagcttgtttacaaggtcaagtcaaatcatatattggagaaactggcattgagttctgtggatgccagtgaacagaccgaatggcaacaacttgtagacgacgctaaggaaaatctacataagatccaggatgatgaatttgtggtgaattactgcctgaaagctcagtggataacctatgaaaccactcaagagatgctgaattatgccaaaaccaggcttttgaagaaagaagataaaactgctctcatttattctgatggcttgaaagaggtgctaagagctcatgcaaaattgactactttttatggagcatttggaccagaaaaattcagtggcagttcttggattgaatttctaaataatgaagatgatcttaaagatatttttttacagctaaaagaaggaaaccttgtttgtgcacagtatctttggcttcgacatcgggcaaactttgaaagcagatttgatgtgaaaatgctggagagcttgctcaactcaatgtctgcatcagtctctttgcaaaagctgtgtccatggtttaaaaatgatgtgattccatttgtaagaaggactgtgcctgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401319 - DNA, 2920 bp, Homo sapiens
aaaaatataagacattttatttgccaacagttgacttatcagaaaggtaatcagtacagaaatgctatatgttttgaagcttaattcttctgcagtaatggaactggtgttctgttgacattaacaatcaaacttttcagatgaagaggcaatggttaggatgactaagaggagtttcggacccatgtacacctcaaatctcagaatgatggctgggttgggtagtgtgaggttggaggagctatagacaaatgtttctttttgaaaaaggatactaagaaggcaagtcatgatgttgcccttactctgatacatttcagtgtagagggtttttttgctttgtttttttctttttatttctagatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401320 - DNA, 2544 bp, Homo sapiens
ccgggttcacaccattctcctgcctcagcctcccgagtagctgggactacaggcgcccaccaccacgcccagctaatttttttttgtatttttagtagagacggggtttcaccgtgtttgccaggatggtctcgatctcctgacctcgtgatccacccgcctcggcctcccaaagtgctaggattacaggcgtgagccaccgtgcccggccgattgtagctcatttttaagggagtaattaatttaacaatgtagtgcagtgacatttttatatttgtaatctgtgctgattattgtaattgaatgttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401321 - DNA, 1367 bp, Homo sapiens
caggaattcggcacgagcagggacggctgtgtggatatcggcttcgaaaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaagacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401322 - DNA, 1233 bp, Homo sapiens
tcctctctctcctactcccgcgccacgccccatacgcgacccaggaccggtcagacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401323 - DNA, 750 bp, Homo sapiens
tggggcaaggtgttaaaccaaaacccttgttttcagcctcctgcctttaagtctagacaactgcacaattggttgtaaaattctcaccctgtcctcaaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaactc

SEQ ID NO: 401324 - DNA, 4336 bp, Homo sapiens
ttcccttttggggtctttgctcttgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataaggttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccgtaagctctagaaacttaatccaaactcttctgtgcatctcagcttaacatttttttcctgtttatttaccatgcttgattgcattaacagatgattcagataatgctcacgtacatatgtattcaaagtctgtctcatctcctaaggcaaggcattgtcttgcaccatgctccatttagttctgggtctctgtaacatctggcttaggcgtgctgaatgggtggcacctattggacagtttccactgggctggtctggcattcacagtgggttaactccctggtcagtccacattcctgaagccaggagccaaacaaactgtccacaaacaagtctccaccaaggcctaatctggctgcatgctctggtcagaccaccccttctgcccactaaattctagctagattgaacttgcaatttccctaacggcaatatgacctttagcttcaggttcttgcctatagaaatgtcctctgaggcagttggagcagagagaggagaaggggatggaccagtaggcaaatgattctcagaaaagg

SEQ ID NO: 401325 - DNA, 528 bp, Homo sapiens
catagggatgcaagtgtcgagaagactgggtataggtatactatatgattggaaggctagaggtggtcctttattttattgaaacatagcgaagaaattatcttagaattttgtgttttactaaatgaatatgaaacttcacatttcatacagcagatattaagaagggcctgctatatacctaaggccatactagatacatgacattcatatatcgtttgattcccacttcaacccagtaaagtgtaggtacttttacttccttctgtcctcattgaggaaactgaagttcattgagactgtgcactcacatcacccagggaataagtaagatgtgttgttctagagctactactgctactactggctggtaagagccaattgttaaatatccaagaacttgtaacccagccatggtttgcattggccacaggaggcacatttataccttagaaatcagcaaatgctgcaaatcagagctctctttgaatttccagagtcatttgctaggacactttgcatcttgaa

SEQ ID NO: 401326 - DNA, 457 bp, Homo sapiens
ttttttttgagatggagtctcgtcctgtcgcccaggctggagtgcaatggtgccatctcggctcactgcaacctctgcctcctaggttcaagcgattctcctgcctcagcctcctgagtagctgggattacaggcgcgagccaccacgcccggctaattttttgtatctttagtagagatggggtttcaccatgttggccaggatggtctcgaactcctgacctcaagtgatccgcccacctcagcctcccaaagtgctgggattacagacgtgagccaccgcgcccggcgcatacatttaatttctgatagtaagtaattctacatgattatatctgtcaaatgactactccatgttccttgaagttatttttttaaacatcacaaccattttgatgggactcttactaaaatgtattattttccttctgtcttcataaaaagataatatggtgag

SEQ ID NO: 401327 - DNA, 324 bp, Homo sapiens
gaccttgtaattcccaacccaaatggccttaggtctcttcaaagtgcctgcagaagtttcttccaatattccttttacagagggtggatagcttagctggggcgcattcctggtcctgaatgttggccagggggtggctggttagggtgacggtgatggtggatcaaatttggacatattggtggcgtgtccacatgaggacccttgaagtgtgggtagagcctgggatgggaagagaatgaagtcaggttttatagcccccacaaatgctagaaataggcctggccatcacagcattcaccgtacaatattgctttgattcct

SEQ ID NO: 401328 - DNA, 180 bp, Homo sapiens
tacgacaaataaccctactcatgttgcttaagtgtacttaaagtttctcatcttacacaaactttgttggtatatggctaattctgcatctagaataatgcatgatctcattctttcaagctgaatttcttttaaagctttttcactaaaagctgtatacacacgtctttacttctggga

SEQ ID NO: 401329 - DNA, 694 bp, Homo sapiens
ttgcttatgctgaggactgctgtgatttgaatgtacccaccaaaactcaggttgaaatgtaattgccattgtaacagtgttgagagttgagaccttcaagaggtctcatgattaggtcatgaggagtactgttagttattgcaggagtgggttcctaataactggataagtttggctcccatcttgcctctctgtctctcatgctgtcttgggcctttcaccatgaggtgaccctccccatatgcaggcaccgtgctcttggacttcccaggctccacaactgtgagaaataaatttattttctttataaattacccagtctgttgtattctgttatagcagcagaaaatgggctgagacagaaagtagtatgaccccaactgagaagtctcctagggggaaagaaaaaaaaatcatcagttcttagtattacctctttggaatgtattttttataaaatctaaattcacaaaaagaagctgagagtatgtgatgcaatagagcttcatttttgtaccagataaatgtactggctgaatacataattgtaatgactgaaagtacacagtccttattaatttctactggcaagatcttctgggaaagcagaagaaaaaaagaggaagcatggtgaaacacacacaacacacaagaaggaagacaacttaggagaagtaacaaataggagaagaaa

SEQ ID NO: 401330 - DNA, 1153 bp, Homo sapiens
gtggtcctgaggtgacatacatcctcagcttatgaagataacaggattaagagattaaagtaaagacaggcataagaaattataaaagtattatttgggaactgataaatgtccatgaaattttcacaattcatgttcctttgctgtggctccagccggtccctccgttcggggtccctgactttccacaacacacaagaaaatttaaaaaatttaaaaccaactattcctccaaaaattaaaaatagaaatatcatatgatccaggaatttcactcttcagtatatactcagaagaactggaagcagggatgtgaacataaatgtgtacatcactgttcatagcattattcacagtagttaaaaaggggaaacagcccaaatgtccatcaacagatgaatggatgaacaaaatgggatatttaagttatgtacaatggaacattattcagccatagaaaagaatgaaattctgatacgtgctgcaacatgggtgaaccttaaaaacactgtgctaagtgaaataacccagacaaagggaaaatataatatgattccacttgtatgaagtacctagactaggcagatttgtgagcgacagaaagtgccacagacgttaccagaggctgagagtaaggggcaatggggagggaggtattgtttaatgggtacagagcttcagtgtgggaagatgaaaaagtcctggaagatgaaagaaaaaattctggaaaattatagtagtgatgggttacctaatattgtgaaagtacttaatgctactgaattatacactaaaaaattgttaaagtggtaaattttgttacatgtattttactggaatgaaaacaattaaaaccatctataaatcatggtatccagaggaaacaataagtattttggctgattttaacactttttttcccctgtagatatgtgttttataaaatttggctaataatactatgcatgtaatcctgagctcttgaattttacattttaattgtattttccttatcattaaatacaatgaaatcaccacctttaatggttgcataatttaacattatatggatgttccatgtaatgttaaatatgtgtaatgttccatgtcatttaattgtattttccatgtcattaaatataatgaaatcatc

SEQ ID NO: 401331 - DNA, 696 bp, Homo sapiens
ctacgactcgttccagcaccgtgggggctgacacccatctcactgctggataaaagagaatgagatcctctctccatcctacgttggatttgcttgctcacacaaactgacccttagggacagaattgttcaactacaattagatttagttaactaatcctggaagcgaagcttagcatatcagacagggttctggcaggagactcactgccctcagaaagttcaccctcacaggctgcaacgcagtgactgtctacagcgatggggatgtggcaggggctaaggaagccaacaagagattgtcaccttcttagaggagaaagccaagatggggagatattaacccctatgcgtgaaaacatgaggggaggaaggaatgtttagcccagtgagactcagaggcacgagtcagcacctattacagacgtggtgcagaaacatggaggacatggagaagaaatatcctgaccttgttccactttcaccctccaattccctgacagtggttcccattgactgagcccagctcgcagtcacaggcagggagcaggggtcaatctcctggtgcacaggcaggctgaggagggaatgaatgtaggaaagggctggggagagaaaataagtagcatgccttacttaagagcctcaggatctttatctgtaaaattggatgataacatctacttaatagtgcag

SEQ ID NO: 401332 - DNA, 590 bp, Homo sapiens
aaactgtttgcaaagtacatgtctgataaagggcttgtatcaagaatatgtaaagaactctcaaatgtgataaataagaaataaacaacccaatcgaaacattagcaaaagatttgaacagacacctcaccaaagaagtcatttggatgacaaatactcccatgaaaagttgctcaacatcattagtcattagggagacatgaattaaaaccatagcgagaaagcactacacacccattagaatgtttgaattagaaagactgaccataccaagtgttggtgaggatgtggagcaactggaaggaattctcatacacttctggtgggaatataaattggtataactttggaaaacagttagatggtttctttctttctcttttcttttcttttttgtagagacagggtgtcagtatgttgcccaggctggtctcaaacttctggcctcaaacgatcctcccatcttggcctctcaaagtgttggaattacaggcatgagcaactgcaccctgccaggatggcttcttaataagttaaacgtatacttttatacgttttgaagagaaacaaaatgtgtgtccataccgaga

SEQ ID NO: 401333 - DNA, 324 bp, Homo sapiens
ccagacagtctctcgctccaaaggggctggccacaagcaccatgaagacagcagtacccactgactcagcaatttcaccagctggaagtcatcccaaggagatatcacagaaagaaaaggccatcttgcgtaaagatgatcactgtgtcattactcaaaatagccccaaactgggaaacacccagctatccagcaataggggtagtgaattacagaacatcaactagatggaatattatgcacccactaaaattagactacgtgaaaacacagaaacaacatcagtaataaaatgttaataaaacagaagcagctcagtacaca

SEQ ID NO: 401334 - DNA, 538 bp, Homo sapiens
cgcgcgccagcaggtgggcgcgttctcccgcgcgcgtgcgcgcgtcgaagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacggtaagagcggccgggaccgcgaggaaagggacagagttcgcgccgaggcgccggggccactctggctccgccgacgccgct

SEQ ID NO: 401335 - DNA, 2038 bp, Homo sapiens
cgcgcgccagcaggtgggcgcgttctcccgcgcgcgtgcgcgcgtcgaagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaata

SEQ ID NO: 401336 - DNA, 2514 bp, Homo sapiens
cgcgcgccagcaggtgggcgcgttctcccgcgcgcgtgcgcgcgtcgaagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaataaaaaaaaagaaaaaaaagacaacaatgagaatcaaatcgggaagcccaataaacacgaccaccaaaaagcacacgccaaacatgacaacgaaaagtcgaaaaacacgtacaaaacatgcaccaaccaaggaacacaaagacaccgacacacaaagctaaccacgcgcgaaaaaaaacatattcgatctagcatgaaaaaagccacacaacaaggagcactacctgctctgaaaatgtagtggttatcttaataatattatgtgtctgtagtcgaactacctccatgaattaacacatactcacagttgtgcctgtaaacacacagacctcttcaaatacgccatattcctcagagcgtaagagattgtattatactgatggtgtgtagctcctacattacacatcccatagctgctctactattgattaataaaaccagactacgaaagtaatcatatactagttttgatctcatg

SEQ ID NO: 401337 - DNA, 2129 bp, Homo sapiens
cgcgcgccagcaggtgggcgcgttctcccgcgcgcgtgcgcgcgtcgaagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgttgtttttgaagaacttacatccaaacagacaagaaaaggataaaagcaccattggttcatggcaagttattacattttaagtgattaactggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaata

SEQ ID NO: 401338 - DNA, 1012 bp, Homo sapiens
cgcgcgccagcaggtgggcgcgttctcccgcgcgcgtgcgcgcgtcgaagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcggtaagattcaaaaatatatagtgatttgttttactaaatatagtttcaaattctaggctcaggtt

SEQ ID NO: 401339 - DNA, 1120 bp, Homo sapiens
cgcgcgccagcaggtgggcgcgttctcccgcgcgcgtgcgcgcgtcgaagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcaggtaagagaactaggtacaaatatagaaaagctttagttgttctgggaaagctaattatagaaaaatatttcttttttgtaattataaagtgatatatgtgacattggtcattttttgcgttgtcagtagcattgtgtaacagaataaacaatgttgtattgattggaggaagctgaagttctcagtagaaaaatctgagtaatggcttcaaatcatttttttctatatccatagtttgatttcttcaagatgaaagctatgcaaataaaaaggtatgcagtttgaaaatat

SEQ ID NO: 401340 - DNA, 2221 bp, Homo sapiens
cgcgcgccagcaggtgggcgcgttctcccgcgcgcgtgcgcgcgtcgaagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaatattttatttgtattgttgtataaaatatttacaatcatatagaatatatagagttacattttaatagcaactgtgtacatgtcacgaaaccatttcccttatcaaagatgtaatttgtaaacctcaaatagttgtgtatctgtcctgttagaagtagatgacttcaattaaacaaatttatgaa

SEQ ID NO: 401341 - DNA, 2861 bp, Homo sapiens
cgcgcgccagcaggtgggcgcgttctcccgcgcgcgtgcgcgcgtcgaagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacgggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaatattttatttgtattgttgtataaaatatttacaatcatatagaatatatagagttacattttaatagcaactgtgtacatgtcacgaaaccatttcccttatcaaagatgtaatttgtaaacctcaaatagttgtgtatctgtcctgttagaagtagatgacttcaattaaacaaatttatgaaggacattattctgattcataaaagttataaaatattaggtaaatacagagaaaacaataagcctctgaaataagtctgtttctgaaatagtcaatagtcttcccatccaaactataagagaatgtgaatttcttcaacatcatacttaaacattacagaaaatagaaatacaaacaaggttggtacatgagagaaaatgttgaccttttacttccttttacaaaaatgaaaataataaacatgttttcgtataaaataacacaaaatgatatacactgaagttgatgaagcaaataaatattctggcttctttttcaaggtatcagggcaaacaatttccaaacttttcattttgtacagaaggatgaataactacagctcatgggaaatgttttgactttacaaagtatagatgttggaacattaagaaaaatgtatattcccaatgaaaaaatagttatatcatcttatagtaaaccaaaagattagcaataatactatggacacattagattatatactacagacacatatctatccaaaatacctattttaaatttttaatacaatattttattttaatataaacatctgtcagttatagacaaagataataattcacaaagtacatgctatcaga

SEQ ID NO: 401342 - DNA, 1948 bp, Homo sapiens
tgccccgacgaggcgtttccgatctttgccgcagtccggatttcctgggtctctgggcactgaaggggaaatgccctcgggatgtttctagcaacccccttcccccaacacacacacactagttggcattctcttccagaaacttatcattttcttttttaaacctcccatcctcagactccccaaattaacaagtctttttagcctcttggattgggattaggatgacagtttttcagtgagggcgcagaaaaacagtgcatttcagcaccaaggacagacacaatcttcatggttcctgggctctgagtcagactgtcgaaaatattggcctaatatatgtgctgtgattcagactttgtggcgaggaacaaatcacaagacagtggcatagcagagatggaagaacttcctgtaccacataacatcaaaataagcaatataacgtgtgactcattcaagatttcatgggaaatggattcaaaatcaaaggatcgcattacacactattttattgacctcaacaagaaagagaacaagaactccaataaatttaaacacaaggatgttcccacaaaattggtggcaaaagctgttcccttgcctatgactgtccgtggacactggtttttaagcccaagaactgaatatacagtagcagtgcagactgcctcaaaacaagttgatggtgattatgttgtgtctgaatggagtgaaattatagaattctgcaccgcagactattcaaaagttcatctaacacaattgttggagaaggctgaagtgattgcaggacgcatgcttaagttttctgttttttatcgtaatcagcacaaagaatattttgactatgttcgagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaata

SEQ ID NO: 401343 - DNA, 1220 bp, Homo sapiens
ttattctgatagtaagagaggtattcaggcctttaacagtagatgtttgacttttaggccattcaaatatataaatcagtgggtttaccactattgtattaagcagtgaccacttgttttctcttgcagagaacatcatgggaatgctatgcagccatctgtcaaggataacagtggtagccatggctctcctatcagtggaaaattagaaggcatcttcttcagctgcagcactgaattcaatactggaaagccaccccaggattcaccttatggaagatacaggtttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtttgtctactgcaaatgcaaagaaagatcccagctgcaaaacctgtaatatcagtgttggacgttaatgcccacttttcttattcttactcagccccttttcctcccttaggagcattggtcctctgttgtccatttttatcaccagatgttttccactgaagcatgcacatgccactgtcaccaaaacaaacaactaccactttccaaatttcattcagaaccattttagtgttttcctattccctacccctcccactactttcaatgatgaaataccctaagttaagttctccttttgacactttattgcctagatgctgcaatgtttttatgtttcctttatgccaaacataacaaaacagttatatagactgctttagcaaagtacacaataatggcttataaatggtgtttaaatatgcattcattttaatctactgaacaaatattgggataactccaaaccgcatgaaagggtgtaattgcagcatgagttaaatcttgaagcctagaattgtcagcacttccaacttcttgtttgacagtgttatttatgttatttatattagctaacaggaaacaactactgtgtttcaacataataaatataatagaaaaata

SEQ ID NO: 401344 - DNA, 1104 bp, Homo sapiens
gccacatgtggcccacagaccgtgggttggacaggcttgttctaaatgtttagtttttttcccccaattcaccagcagttaccttcatgccaagtgggcagcagacacaagacaatcacttggcaaaatctattctttcaatactaacattatttacaaaggaaaaggaagaagcttgaaagaacacagaaagccaaaagacctaattgaacgtctgttaagaaccagctccttcctccaactgtgccagaaagtaactaagcttttggctggtccagcaagacagggcagtcaggctgacaatggtgctcttgctgaactttcagccagagtgcgattctgaactcccgggtgaacggtacaaggaaatcctgactgcaggctgggtcaacccgcccaatgccatcggacaaagaataaaacattactaccagggttccaaatgtgagccatctgactacgtcttgcacactgaaacctcagactagccaattctgcactccaatctccttcaaaagagagccgggagagactgctgcgagggacaggcacagaagaaagaccctgtgagaacacagtgagaaggtggccatctgcaaagaggcctgccaggagggaggcctcagaagaaagcaaacctgcagacatcttgatcttgaacttctagcctccagaactgtgagaaaataaagttctgtttaaggaaaaaaaaaaaagagagagagtgtgtgttgaatattctttcagttctatcttaaaatcaattacactggaaaaaggcaaaacgaagcaaataaatgacttctttcccttttcctgaattcctgacctccactcttctgacttcccaaccccacctctccagacagaaggaggactgatttgggtaagcctaagagccacagccgaagcacttactgtgactgtcagtcccaaagaatgcaatattcatcatcactgtcacacggaatgtgagaaagagaaaagtgatcccaggttacagtaacaaacctacagccaaagttaatttcagcgttacagagctaaggcaaacagaaaacgttacgggtgtattcaatattaaaacatatttcaccatcaacg

SEQ ID NO: 401345 - DNA, 854 bp, Homo sapiens
gccactatgcccagccaactagctccctttctcctgcagaaataagaaaaagtctctctctctcatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 401346 - DNA, 4663 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 401347 - DNA, 5591 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgagtaccctgagcagggccacgccggcagagtcgcaccacaaagtaatcctcctcagtgactgaagagtctggatcctgtacttacaaagcagcttctaaggattgcaagctttcaggcaattcatgaattagctgccacatcgtggacagaacggacgttctgtggaactgtacctgttggtacggctcctttttaggtggcagtgtgctgaagcaggaaaataacagacaagttaaacatgagacagctggcagtctttcccatttaaaatgcaggggagcccgggccagaacccagcgtgtgatgtgcggttggtgcctggagagtcgtcttggttcaactctacaccctggcttagcctatctctttaccactgtagaaaatacctggtaaagagtaaaaactaaaactttgtttcgtaacacttttaaatatttaagttttcacctgagaatataaagaaagataatcaattgggagacacgatgcagtgtctgtgcagaatacacagcttttaacttggtcatacctctcccccaggatcataaggcagcaaatagtgttaggtagtagatgatgctacctgggttcagttcccattgctttgaaccttgaatattaagaaatccccataagggctggccacggtggctcatgcctataaccccagcactttgggaggccaaggctggcggaccacttgcggccaggggttcgagaccatggccaacatggtgaaaccccatctctactaaaaacacaaaaattagccaggcatggtggcgtgcacctgtttaatcccagctactcaggaggctggggcaggagaatcacttgaacctgggagaaatccttgtaaggaagtgtttttgttcaattacaggttggtaaaagtggtttctaacacagtatctcttcttttaggtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 401348 - DNA, 4604 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 401349 - DNA, 4730 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaagttttggggttaccctatctgctttgagagacaaatacaaaagctaaatggaagagattctatctaa

SEQ ID NO: 401350 - DNA, 1006 bp, Homo sapiens
cggacgcgtgggtcgacccacgcgtccggagtgcacttgcccacatgggccagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 401351 - DNA, 4339 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagcaaagcttctggaaagaactatctacttgtgcatctcacagcacattcattatgcaacccagatggctccactacagtgtctcatgaccgcctcagacagatgttaaaaagtgaactcagctgggcacagcggcctacacctgtaatcccagcactgtgagaggatgaagcaggaggatcacaggaattcgagaccagcctcagcaacacagtgagaccccgtctctattccaatacatacattttttaaattaaaaattcatttaaaaaaaaaaaactcaagggatggattacagaagggcccaaggaaacttttcggggtctgaacatgttcattgccttgattgtggtgatggtttcatgggtgtatacatgtcaaaactcacatattgcataatattaagtgtgtacagtttattatgtgtcaactatgcctcaataaagctgcttttaaaaatcttt

SEQ ID NO: 401352 - DNA, 4726 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgagtaccctgagcagggccacgccggcagagtcgcaccacaaagtaatcctcctcagtgactgaagagtctggatcctgtacttacaaagcagcttctaaggattgcaagctttcaggcaattcatgaattagctgccacatcgtggacagaacggacgttctgtggaactgtacctgttggtacggctcctttttaggtggcagtgtgctgaagcaggaaaataacagacaagttaaacatgagacagctggcagtctttcccatttaaaatgcaggggagcccgggccagaacccagcgtgtgatgtgcggttggtgcctggagagtcgtcttggttcaactctacaccctggcttagcctatctctttaccactgtagaaaatacctggtaaagagtaaaaactaaaactttgtttcgtaacacttttaaatatttaagttttcacctgagaatataaagaaagaccctgtgagaacacagtgagaaggtggccatctgcaaagaggcctgccaggagggaggcctcagaagaaagcaaacctgcagacatcttgatcttgaacttctagcctccagaactgtgagaaaataaagttctgtttaaggaaaaaaaaaaaagagagagagtgtgtgttgaatattctttcagttctatcttaaaatcaattacactggaaaaaggcaaaacgaagcaaataaatgacttctttcccttttcctgaattcctgacctccactcttctgacttcccaaccccacctctccagacagaaggaggactgatttgggtaagcctaagagccacagccgaagcacttactgtgactgtcagtcccaaagaatgcaatattcatcatcactgtcacacggaatgtgagaaagagaaaagtgatcccaggttacagtaacaaacctacagccaaagttaatttcagcgttacagagctaaggcaaacagaaaacgttacgggtgtattcaatattaaaacatatttcaccatcaacg

SEQ ID NO: 401353 - DNA, 2549 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatggtaagtaagagaagctttgacttttccttttagataaagtcatctcggttttgtcattagcatcaagtggtaattatgaagatttcataaattgggcagttttgttaatttcttacctcttgaatcccagaatagtatctcctttggctttgggtttgggtttcattccagatttaaaagaagtggattgggttagccatttttaggtcacacatgcctttgagaagctgtcgaaggctaagtacctttccccagaataatgcaattgcaaacctctgcattgttgttcagcttgaaggtcatgggcctccgaagttcatttatagaccctctagggagctcatggacctcaggtaagagcctctgtgatagagaaaagatagtatgtgaggtatgtggaaaaagaaacaaagttgatggattttttttcttctaagccagtcagttgagtatttggacactcttacagtgtgaagagcagctggtttgctctttcctggttcctgtagcactttagaaccaattgtacttgacaaaatgaggtgattattcatgtgacacctttggcatcttaagccaaattacaggctcaacaggttttgcccaaccagttaagaatccagataggttttcttctcctcacttggtggcaggggagaagttgcaatctgtatttaaaatttactgtgcatcagagaggaaaatgccatttctaattgttggagaagggatggtgtcagcaactgactagccataggggaaacaattgact

SEQ ID NO: 401354 - DNA, 2171 bp, Homo sapiens
  misc_feature (2015)..(2015): n is a, c, g, or t
  misc_feature (2022)..(2022): n is a, c, g, or t
  misc_feature (2024)..(2025): n is a, c, g, or t
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagccagaaaaaaanataaatntnntaatatataattataaaattatcattatatttatattctttataaatatttttattataatatattaactaaaaaaaaaccttcagggggggcccgggcccaatttgccctaatgggggccgattacacataacgggccgcggttt

SEQ ID NO: 401355 - DNA, 346 bp, Homo sapiens
catgttttaattgtatgtaacgtttctgttgcctacatctattttcttcattccaactttttggtttatcttaaagtttatttcacataatccagttttttcttatttgtccagtccatcacctaagaatgcaaactcataacatgtgttgccggagcagacctagaaatgtttacaagtcctctctgaaacacagaattgtacattcaactctaggtttaatacagccctgtaaagtaaaaaggaggaccttttagtaacaagtgggacagacaaccctgtaactaattggtgattgtgtctgtcgcctctctcaggtggattcgaaggtctcactaggcatcgc

SEQ ID NO: 401356 - DNA, 376 bp, Homo sapiens
atcatccgggcccctctcactgacaaacacatttaccagccatacccttcgggagctgatgtaccctttggacctccgcttgacatacagatactgcaccaggtaacctgctgtttgaagaaataagtcactctagatgaccttgtggtttgctggcttttacatgttgactactgctagatggggatttggggctgaatgtcatggtatatcttgaaaatcttagcgtataatggcaaagctgcctttaagttaggtttcaagaaagtgaatgatgttgaacttaatggaatatttattgttgctcacttttgtatttacttcagatagtagaccttgcctttttcttgaaattgagatgagcagagaaagaaga

SEQ ID NO: 401357 - DNA, 444 bp, Homo sapiens
tcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacggtaagtggcaagagacaatcattggtagacaccattcttgggtctgacttagggtacatgggcaaaagcttgttttatgagcataacccagaggtgagcaaacaacaagaccttgccctgtgaagtttacatcatctttttttttttttttgagacagggtctcgctctgtcgcccaggctggagtgcagtggcgcaatcttggctcactgtaacctccggctcccaagttcaagcgattctcatacctcagcctcctgagtagctaggactacaggtgtgt

SEQ ID NO: 401358 - DNA, 5470 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaacaaaaaaaaaaaggggggggcacacacaaaaatatccccaaggaggacaccaaaaaacacaaacacacaatattcagaaagaagggcgccacataaaagagagcagcaaaaaaaaaaagcacagcagcggacgcgccgcaataaaaaaacagagccagaggggggagaacacaagcggcaagggcaacacatccagggaagagaaacactaagcgcggggggaaaacaagggggaaaaaacacacacggaaaacaaaaagcagcgaccaggagggaagaacaacaaaacaccaacccgcgagcggaactaaggggggaacacaacaccacgacgcacaacaccgaggcgcgacgaaaacacatgcccacacgaggaacaagaaacaacaaaaacactacaggggggagtaatacaagaaaataagacccaccacaacagaaacaacaggaccagcacatagaaaaagccgaccacacacccacacatacgcacaggcaccccgaacacagccgcacgagcacacgcagacaccggtaaatagacacaacaagacaaacccaaccaacacacaaaaaacaaagacagagaaagagaacaaaaaacagaaagaaaaaagagacaaacaacagaacaaaccagaccaaccaaatctagagaggtagaaacaaaaggagagacataatcacgaaagcaaacaagagaaagaaaacagag

SEQ ID NO: 401359 - DNA, 4200 bp, Homo sapiens
gcaaagttaatcttcaagagatgggcctcacacatgcccaggctgtctggaactcctggtcttaagcaattctcttgcctcagtcttcccaagcactggtgagccactgtgttagggtcttccacactggagactatcagattacagctaaggttccatacatgctgaattaaagtaagtttagggctgggctcaatggcttatgcctgtaattccagcactttgggaggctcagacgagaggctcacttgaggccgggagttcaagaccagcctaggcaatgtttgcatgtctctaaaaaaaagaaaaaagagaatttaaaaagaaaaaaaagcgtacaattcagtagctttactatattcacgtgtatgtgcagccatcaccacagtcaattttgggacttaggggaaagaaggcagtaattagggaggaggaggccaggaggaggaagaaagcatttcatgggattacaggaatgtcccaaaaacaacctcactgtgatgaagtccactaatgctatttcttcacttctgtttttcagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 401360 - DNA, 5003 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactagtcagtaccaccttgtcttgtacttcagaagcagcggaggaggctctcagccaggcagtcagctcaggcctgaaatgtctcactgaaaatagactttcttggaaaagttgtttttatgcaaaatgtatgttaaatctggctttaccttaaaaaacctttgaaaggactaatttaccacctaatactttgaaggcttttttcattaagtgctcatgtagtttttcttttgactgttagcagtataaaacgtagaaaaggaagttaggttttaagaaaaagtactgaaactaaagacttcctccctgtggagcaggtcagtaaccctgtctgtcctctctagtacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 401361 - DNA, 4772 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacccccccaaaaatttttttttttttttttttttttaaaaaatttaaaaaaggggttttttttttttaaaaaaaaaaaggggaaaaagggcccccctttctttttttaaaattttttaaaaaatttggccccaaaatttaaaaaatttaacctttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaa

SEQ ID NO: 401362 - DNA, 5267 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgagtaccctgagcagggccacgccggcagagtcgcaccacaaagtaatcctcctcagtgactgaagagtctggatcctgtacttacaaagcagcttctaaggattgcaagctttcaggcaattcatgaattagctgccacatcgtggacagaacggacgttctgtggaactgtacctgttggtacggctcctttttaggtggcagtgtgctgaagcaggaaaataacagacaagttaaacatgagacagctggcagtctttcccatttaaaatgcaggggagcccgggccagaacccagcgtgtgatgtgcggttggtgcctggagagtcgtcttggttcaactctacaccctggcttagcctatctctttaccactgtagaaaatacctggtaaagagtaaaaactaaaactttgtttcgtaacacttttaaatatttaagttttcacctgagaatataaagaaagataatcaattgggagacacgatgcagtgtctgtgcagaatacacagcttttaacttggtcatacctctcccccaggatcataaggcagcaaatagtgttaggtagtagatgatgctacctgggttcagttcccattgctttgaaccttgaatattaagaaatccccataagggctggccacggtggctcatgcctataaccccagcactttgggaggccaaggctggcggaccacttgcggccaggggttcgagaccatggccaacatggtgaaaccccatctctactaaaaacacaaaaattagccaggcatggtggcgtgcacctgtttaatcccagctactcaggaggctggggcaggagaatcacttgaacctgggagaaatccttgtaaggaagtgtttttgttcaattacaggttggtaaaagtggtttctaacacagtatctcttcttttaggtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagcaaagcttctggaaagaactatctacttgtgcatctcacagcacattcattatgcaacccagatggctccactacagtgtctcatgaccgcctcagacagatgttaaaaagtgaactcagctgggcacagcggcctacacctgtaatcccagcactgtgagaggatgaagcaggaggatcacaggaattcgagaccagcctcagcaacacagtgagaccccgtctctattccaatacatacattttttaaattaaaaattcatttaaaaaaaaaaaactcaagggatggattacagaagggcccaaggaaacttttcggggtctgaacatgttcattgccttgattgtggtgatggtttcatgggtgtatacatgtcaaaactcacatattgcataatattaagtgtgtacagtttattatgtgtcaactatgcctcaataaagctgcttttaaaaatcttt

SEQ ID NO: 401363 - DNA, 4030 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacataggtaagagttctcatcttaaaagggtggcacaatagaaggacattactgaaagggaattctatcctgaggcattcttttcaagtatttgaactcatactaatggtcatttgataatgataaatgatactgagtaaaaaaatttcttctaaaaga

SEQ ID NO: 401364 - DNA, 2848 bp, Homo sapiens
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagaggtaagttggtgccaggattatagtctatttaatttgagtctagaatctagaggaagcagctagcgggtataacctttgtttccctctgtcccctcagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtggtatgcgcttatctgtggtttttctctttcctctcactgaaacagattatcacatgccttctaagaagccagacagcctgggaaggagattcttaaagctgttaaaatgtatct

SEQ ID NO: 401365 - DNA, 177 bp, Homo sapiens
gcatatggagttcgtgtttcccttcaagaggccttttgtaagatcttgcctcgtgaattacagcaagcatcttgtctcctttttcctttgggtttcctcttctagcaatgtacaatgcctgccgggatgtggaggccccctcaagtaatgacaaggccctgggactcctgtgtggga

SEQ ID NO: 401366 - DNA, 305 bp, Homo sapiens
caaatgattaaatttcagctctcacaaatgtggaaagtaatgctcaagagagaagaaaatcaatggcaaatgttagagtttaagataaaattctccatccaaattactgcatatggtgccatttgctccattttctccttcttcctaatgaggttactctaggacagctgtgaagattcttgtactcttattagtgagagactgccagtgaaaccaatatgtcatttgtcataaactttgagtcactgacccagaggtgagactaactgtataagaaataaacaaatgtgttctgcttgaccctg

SEQ ID NO: 401367 - DNA, 165 bp, Homo sapiens
aaattttagtctttttattaaaccagacattttattttcaggcagttacataaataaaaatttatatctctagctatacagattatcattgcagtaataataagaatattaaaacctgtaaataatcaaaaggttgttacaataaattatggcaagttcatatga

SEQ ID NO: 401368 - DNA, 573 bp, Homo sapiens
gtacatttccccaattggaaggctactgccttcaaaagttagctttgggtactgctttctcttatgtttacaagaaaaccacagccaaatgccttgcctgcccatctgtgccatattagacatctggacaaacttggcccttgtatgcacatcaacgtgatggattgcagatttgttctgtcaacttccacagaacattcactcaagatacagctctccaagaaaagtctctttacctgtgtttctaagaagctctttatctttgaatgcatgactcataaattggatacattacaagagcttaagaagcagatttatagcagggattctttggtaaatctattcatcctgaaaattcccttggttactcaatttagtgatatttaagtatactccctttgctattacataattgttgtaaacaatatatcattgcactcagtttttacagctgtttacaaattgggcaacataatttcaggcagaaattatcgaaaatgagaccagcctttaagccattttgtgaaagcttacttagaagtaatttttgaaaaaaaaaaaaaaaaactttac

SEQ ID NO: 401369 - DNA, 443 bp, Homo sapiens
agaccaggaccatgtagtcagccccattcacctaagtatatgttttcaggatgtgggaggaaacccgagtatccagatgaactggatatcatccaggcagacatggggagaatgtgcacactccatacagacagtgacctcagtcaggaatcagggtttcttatcaatgatataatgaaaagacattggaccggctgggcggtgtggcttacacctgtaatcctagcactttgggaggctgaggcgggtggatcacgaggtcagaagttcaagaccagcctggccaagatggcgaaaccccgtctctattaaaaatacaaaaattggccaggcacggtggctcacgcctgtaatcccagcactttgggaggctgaggcgggtggatcataaggtcagaatttcaagaccagcctggccaggatggtgaaaccccatctctact

SEQ ID NO: 401370 - DNA, 723 bp, Homo sapiens
  misc_feature (13)..(14): n is a, c, g, or t
tgcagtggctcanncctgtaatcccagcactttgggatatttaacaaagtattaatgcaaaaagaaaatcttggacaatacctcaaagtttaaaaaaatttaatttcacgttaatggaggcagggaagcaaagaaaataaaaggcaacacagacgccatggaaatgtgattatgtaagccatttacagttttaaaagaaaatccacacttactgagtactgtgtactatgtccaacaaacgatacgatataccaatagaaaaaaaagagacataatctaagtccacatcaacttaaaaatttagaaatggagggtagacaaatacataactattttacaaggaggaggctggctgtggtggctcatgcctgtaatcagcacactttgggtggctgatgcgtgcgcgcagatcacttgaggccaggagttcaagaccagccgggccaccatggcaaaacctattaaaaacacaaaaaattaggccgggtgcagtggctcaagcctgtaatcccagcactttgggagggagggttgaggcaggaagttgagaccacgcttacaaataggggaaactcgctctactaaaatgccccaaaaataccagcattgtggacatcccggatcccacttcttggaagctgaacacaaaatcttgatttggaggggaggttgcatgagttctattcaacactgtctccacccggccggagaggggattctctg

SEQ ID NO: 401371 - DNA, 597 bp, Homo sapiens
  misc_feature (13)..(14): n is a, c, g, or t
  misc_feature (553)..(553): n is a, c, g, or t
tgcagtggctcanncctgtaatcccagcactttgggaggccgaggagggcagatcacgaggtcaggagatcgagaccatcctggctaacacagggaaaccccatctctattaaaaatacaaaaaataggccgggcgcggtggctcacacctgtaatcccagcactttgggatatttaacaaagtattaatgcaaaaagaaaatcttggacaatacctcaaagtttaaaaaaatttaatttcacgttaatggaggcagggaagcaaagaaaataaaaggcaacacagacgccatggaaatgtgattatgtaagccatttacagttttaaaagaaaatccacacttactgagtactgtgtactatgtccaacaaacgatacgatataccaatagaacaaatacataactattttacaaggaggaggctggctgtggtggctcatgcctgtaatcagcacactttgggtggctgatgcgtgcgcgcagatcacttgaggccaggagttcaagaccagccgggccaccatggcaaaaccctatacacaataggccgnggttaggagaatgacaggcttaagattccccggtggattccgcg

SEQ ID NO: 401372 - DNA, 740 bp, Homo sapiens
gtgaaagaaagggttatgggctctagaatcagaagaattggagttacagaatgtcagctccaacttgtcctagaggagtgacttttggaaaatttggacttttggaaaaaattacattaatttttccccctcattcattaattgagttacaggtaaaaccacacagtgactaacatatatagattgctaaataaatggcaattatttatttatttactgggacaggtcttactgtagcacccaggctggagtgtagtagcgtgcagcctcggctcactgcaacctctgcctcccaggctcaagtgatcctcctgcctcagcctctggagtggctgggactacaggcacaagccagcacacccagctaattcttttgtattttttgtggagacggggtcttgttatgttgcccatgctggtctcctgagctcaaacagtctgcctgctcatgcctgtaatcccagcactttgggaggctgaggcgggcggatcatgaggtcaggagatcgagaccatcctggctaacacggtgaaaccctgtctctactaaaaatacaaaaaatcagccaggcacggtggtgggcgcctgtagtcccagctacttgggaggctgaggcaggagaatgacgtgaacccgggaggcggagcttgcagtgagccgagatatcgccactgcactccagcctgggcaacagaacgagactccgtctcaaaaaaaaaaaaaaaaaaaaaaaaaaacc

SEQ ID NO: 401373 - DNA, 198 bp, Homo sapiens
cggcaggtggggtgcttcttgcggcaggagatgacgctgcgcaggatatgaaggagtctggtcccctctgttttctgcaccttgactttccaagtgggacatgaaatgtcatttgcctcttctgtcttcaatgctgaggggaccctggggtcaagggaagagcaggcctttggagtcagaccttacctgttggagccg

SEQ ID NO: 401374 - DNA, 719 bp, Homo sapiens
  misc_feature (642)..(642): n is a, c, g, or t
tgtgtactctctggtccacacactgatttccccttttctgtttcatggggtgacttgctgaccttctctgtgcatggctagtagtactctattgactggcaagggttgtgtcttccacttgggtcttccaagctgctgaagaaagcaacacagaaagtatagctgacaataattatctgtcaaatgtatgtgaatcacagtgtggatggtcgacctgttgtttcttttttctctttgaaaggaagatttcagttttctctgcagccatggtactttataaattatttcctcttccatctcttaaaagtcactgttatttaccaccccattagctgtggatggggtgaaatgcccactcatgcagcacaggaggatacacagattgtcacacatcttttcaggagaccacacagcagtgggtagtgtagtattaaataaatgcctgaaatatgagctgggaatgcattgcacttcaaggaattttatccataggatgtaactgggaaagtgcagaagaatgcatatatatatagttgttcattgttacatgttttatgatagcaaaaaaaaattaaaaactccgagactaagtctctcctcgtgccgaattctgcccaaggggccaaaacgtgactcgcccgntccgcgcttgtttccccgtgcccgctccccgggccgtagacaagcatttcgaggagaagcccaagaggtgtgaagac

SEQ ID NO: 401375 - DNA, 559 bp, Homo sapiens
tttaaagtactaggcaccaaacagttgttcagtgggtctccaaaaattctgtagtgaagcctgattatactggaaagaggcagtgggtgccttaaggatggtttggttgtatcatcagacttaagtgcgggtgttagtttgggagtaattagttgagttgtactactgaatttggagggaataaaaccaacttttagagattttgattcttttagtaatactgataatctgaaaatataaaattacttgatgcgcaataattattacttgattttaaagaaatctcacacacccaaatagctacagtggtggtagtttcataaaagctaaaggtaacattctacagttgttggtcacttaggagagaaggaatattacaaatgatagcaattcagttcattctctttactgtataagtgtttgtgttttacttttcaaaaacttttgtataacatgtatctctaatatgtacaacctatttttattaaaaagttcattgtaaatgtaaagtttgggttactttggtgttccaaacaataaaaaagaatacacaaaaaaa

SEQ ID NO: 401376 - DNA, 397 bp, Homo sapiens
actgcactcccgtctgggtgacagggtgaaactccatctcaaaacacaaaaacaaatttctacagtaaacaaactgatagagagggaaagtagatccatagtctccaggggctgggatgagaggagaatgggaaatgactgctgacaggtacagggtttctttgggggattacttactaaaatgttatggaattacatagtagtgccgataattacatagctttgtagatacactaaaaccaatgaattgtacatttcataggtgaattttatggtttataaaagataacaatttaagcttttctttaaaatacagaaaacctgtagaataagaaaaatatttacaaatcatatcaagggattaatatccaaaacatatttttaaaacgcctagaat

SEQ ID NO: 401377 - DNA, 333 bp, Homo sapiens
gaaaagccacatagaacttttgactctctctactgttggctggaagccttactgacaacataaatcgttgattaacacattttttgtatgttagatcatcatgaaggtcttccccctcatcatcttcaaattgagtaggctgaagaggaggaggaagaggagtggttgggttggcattgctgtctaaagggtggtagaggtggaggaggtggaaggggaggctggagcagcagacacacttggtgtaacttttactgaagaaaattcttgtgtaagtggacctgtgcagttcaaacccttgttttcaaggttcaactgtgtgtgtgtgtggca

SEQ ID NO: 401378 - DNA, 251 bp, Homo sapiens
tttttttgctaattctgttaacacatgatcagccaaaatcagaatgaactaacttcttcagtctcagaactcccaccattccccacatatcggagcacagacagatacggtatcgctgcaggagaaacgtcaaccatcaggaaataagagtgacacatgcccatttcctgtatattcaagggtcagtccattaagaaaccacatgttagaatgtgggtcgcattccagtaatgcctcaaggtaaaacattt

SEQ ID NO: 401379 - DNA, 379 bp, Homo sapiens
atcattgttgtttttcctttaaaaagcccagttaagcaataaaaagtaatttaggttttgcacagaaacagtcccaaacaaccatgaagcagatctataaggctaacacagaaggcttgaaaattattgaaagcaaaagaaaaatcattccattgaacaataagctatctcttggacttactgtggttaaagaaccacaatattctttttcaaaataagatataccacaataaaataatcaaggcagtgcccaccagagccaaatgaagcacatgaaggaaaagggtattacatcttagtaatagttggatacgtttatatattagaaaggttgataaagatgatagggaaactacagtaaatctgtgtatacacatgt

SEQ ID NO: 401380 - DNA, 504 bp, Homo sapiens
  misc_feature (28)..(28): n is a, c, g, or t
  misc_feature (80)..(80): n is a, c, g, or t
tatcaaagtttacaacgcgcatagcatntgagccaccaagcccacctctaagcatggtcctaaagatagacctggggtcntgaagatggtcctggggtacacaagggcatggctagtgatgagaacaagacggggaggcaggttctgtgaactgtgggacaaccacgcagagcaccgggcagctactagaaggtgtggggtaatgagggaaagcacccaagataaattaattgaaaaaggccaggggacagcatcgctactgggatcccacgcgtgtagccaaggaaaaggacacacatggatgggtttatttataaagagaatttctggatggaatcctataaaacttttagcagtgactgcctctcagaaggaagagcggggatctgagggtgggagaagcttttctttgtgcgcccctttgtgatgtttaaattgtggttatgtgcgcacatagtcctttttttttccaatggacaataaagagaaacctttaatgactca

SEQ ID NO: 401381 - DNA, 418 bp, Homo sapiens
attcagaatacagcatggttaggagtaggatgcacataggggaatttcaggggaacccactccaagatccacatgtaggactcagcacatccagatacgggtgctctcgtaccttgttggtatccacctctgctctccttcattcagctatgttcattctcctgtgatcaacaagcaaagaatggtaaatccgttttctcttaagaatattgaaatatattagctccatatttgtcagttctttctttgtttttcttgtggagttcaaaaagcgattgtgaaatatagggatgaagagactacagacattgccagtgaatactctccgttccgtccttcctacccacccaaacaggtaacttgtgaaaatcaaattcaaagaaaaactccaattaaacttatttttgaggcaaggatt

SEQ ID NO: 401382 - DNA, 710 bp, Homo sapiens
ccctgttgtcttatattggatttcctaaaaatagactctgaggtggagacttatgtgcagaaggtctcttggcgaatgctccagggaggcgtgcgtgtaaggaagtgagacagacccacctcaggcccctgggacttccactggccagacgccctgtgcctacttgtgtcatgggatacagggcccatctcttcccatctccacactctgaccacacgctagtagcttgaaatcagccatggtgcaactattggcatcacaaaaatggacaaatgcttcaaactggggcctgacttattgttttgttgattgccaggcttaaaaagtgatggaaaggatgctaataatgcatattaaaccaaaaaagtgcgtcatgtctgtagctgtgacattgtgaatagcacaagcattgaggttacatgcttctgatatttgaaaacccttattggattcaacaaagaattcactcatgtcattgtctatcaggtgaagctctgatgcacattttttgctttcacttttgccttattcattaatataaacagaatgtcaatcaaccttcatgttgtgtctacgctcaatcatccctgatgaccctacgctgactacagatgcagaattcagcaaaaaccaatgaaagcattcggtgagaatcaatggctatatggagcttacaataaaccgtattgtgtattttattattacgtata

SEQ ID NO: 401383 - DNA, 290 bp, Homo sapiens
tctccagggaactgacttcttcctcctcatggtccacttgaaattccaggaaaaggaacagatgtgcaaggaattgcagcctggagaaacatagtgtatttggagacttgcatgtaaatggataaaatgtcaatcaaccttcatgttgtgtctacgctcaatcatccctgatgaccctacgctgactacagatgcagaattcagcaaaaaccaatgaaagcattcggtgagaatcaatggctatatggagcttacaataaaccgtattgtgtattttattattacgtata

SEQ ID NO: 401384 - DNA, 134 bp, Homo sapiens
attatatatataatttattatatgcatataaatagatgtataattttactttctatgctttgtatacttaatagaatgagtgtattaatgtattcctataatttctcatagcataatttgacattgtcttatat

SEQ ID NO: 401385 - DNA, 439 bp, Homo sapiens
actctgataattaaaaggattttatcttcataaggaaatcgacatttgctgtcaggatgccagaccacaattctatagaagcttttctctttttttttgattgatatggtttggctgtgtgtctccacccaaatctcatgtcgaattgtaatccccatatgtgaggggatgctcctggtgggaggtaattgggtcatgagggtggatttcctccttcctgtttttgtgatagtgagtgagttctcacgagatctgatggtttaaaagtgtatgacactttccccttcactctctgtctctcctgctctgccatggtaagatgtgcttgctttctcttcatcttccaccatgattgtaagtttcctgaggccttccaaccatgcttcctgtccagcatgtggaactggaactgtgagtcaattaaacctcttttattcat

SEQ ID NO: 401386 - DNA, 1018 bp, Homo sapiens
actgttactccatgttgaaggtaaaacagaggcacagagaggttatgtgacttgcccaaggtcacacagctggtaaggggtggagcctgtgattcagacccagtcagtctggctgcagagcatgagctctgaatcaaatgttctcctgcctccattcttaccttttagaaagatgacagcaagttgcatacgtgacctcctcacccccaggagtgtgtgtgtgcacatgtgtatatatatgcacacatacgcgcaccagtagctcagcaagggagggaggctcaggaatgggctcgtgggcctctgtgtgttgatggctgggtttgcagaacctagggagtccggcgtctgtgtgcgtgatgctcctcccttcgtccctccctgctcgcgtggttcccagtgggtggggtgccctgttgcctctggtttagagccgtgcaggatgttaccacagaccgtgtaccaggagtgttcacccaaacttgtgaagggccctggactcccaggaaggagctcagatctaggactgggagtggacggcggccgccggaggagtgagagggggcagtgcgcttgccatgcccggggcccgtcctcctgggcctctctcggcgcttgggcaacctgtgtattgcccacacgtgtgccgctgcttgcagctcctggccaccaccctcctctttgtgtctggacgaatctgactgctctgagcacctcttcagagtggaatcatacaggacagtgtctaccgcaactcccagcacacagcaagtgctcagcacacccggaacacagacttcttacctcctttcccattgtgggcaaaagatgagagaggagatctgagtgcagacatcgcgctggcttggccaagtgctctgttatctttagcaagatgaagagctttgtcaggtgggtaacaaaaaaaattctgacacaggccgggcgcggtggctcacgtctgtaatctcagcgctttgagaagtgtgtcagcccttgagaagacaccgggcaagct

SEQ ID NO: 401387 - DNA, 635 bp, Homo sapiens
gcaagtgtttagaagaagacatggttctttctctgtcttctttaaacaggttatatgcggttatatgcacataaaacaactagaaagatcttctaaggtaccatttatgcaggtgctggatagtatgatacttaaggaacaccagaaacgtgaagggtgatcatggagtagagagcatttacagtacttcttagccactagatgttaatgttcgttatgctgcaaactaaacaaatgctctgtaggttatatatacgtactgatagagatttatgttgtaaatgtgtagaaaaaggtctggaaggatacatatcaaatataactgtgattctgtcttacctctgaggagagctggttggggtggtctcatttttgttagaactaataaatatggtccatattcattttataaaatagttgacggtatctcacacttcattgcacagccaactgaatattaaggattttttaaatagttgaatgtttattgaatattttaaaaataatataaatacatatatatgtatacatatatacacataatgtgaataatgactgtcacctttaatgtacaggtgtgtattagtccattttcacactgctgataaaaacatacccaagactgggcaatttac

SEQ ID NO: 401388 - DNA, 298 bp, Homo sapiens
gctcgaccagtgagctgttattcatgccattgcactccagccagggcaacagaacaagaccctgcagcctcgacctcccaggctcaagcaatcctcctgtctcagcctcctaagtagctgaaactacaggcgcatgccaccacacctagctaacttttttattttttgtagagatgaggtctcactatgttgtccaggctggtctcgaactcctggcctcaactgatcctcccaccccagcctcccaagtgctgggattacaggcatcagccaccacgcccagccgaatagtatattt

SEQ ID NO: 401389 - DNA, 371 bp, Homo sapiens
aacgattatggccaagaagtcaccttaggggaaaaacataagaagaattcttgcttgcaagagagaaggaagcctatagggagagtgaggggagaggccgaaagagagagaaggaaaaaggataaaagagaaatagccaacaaggcggacacaagaaaaagggagagatgagagaaacaggagaggacaaggagacaagaagcagagaggcaagagacagggacagcaatgggactcggaaaggacatgggagagagctggaggaagctgacagagggaagggaagaaccccccgccgtcaaaggcaggactcaagaacgctgcctttcgtgcaagtgagatgggctccgctgcccgcgcccgcttgttct

SEQ ID NO: 401390 - DNA, 607 bp, Homo sapiens
  misc_feature (593)..(593): n is a, c, g, or t
attcagggagtacatatgcacgttcgttatgatggaatcagttgtaccccaaacctcagaattcagattttttaagtataattttatatatagattttgaattaattatgccataaccaattgttttttaatataattctatttttagtgcttgggcatatatattataggttatccctattttaatagaatatattattgtagaaaaataagtttcacgttacctgtgtcttaatggctgcatgaaaacttgtgtttatttttccctttcaaaaaatttgttggcttggaatgctttacaaaaattgtagaggatcacaaggtataattcagattgcagaaattacattggttgagcagaaaaaaatgatacatgtgacttggtgtttgagtaatggaaaccttcccaaggctttttcagaagtaaatggaaaaatatgcatttcactaatatcctagagaaagagagttattaatactaatttgggaaaaattataatagcatttaccgaaggatccaaatttttttaaataacagaagcatttaatcagtcctggcgtggtgctgcacccctgtagtcccaactacttgngaggttgaggcagg

SEQ ID NO: 401391 - DNA, 606 bp, Homo sapiens
tgtgggttaattattctgggtgttccacctgccactcattccactctaagaacctataccttggagtgagtgggacaggagatataaatctcttctccccagatagtttctgtgtctctctcagtgtgggcaactcgttacacaagtgtgattctgacgtttgtagctaaggtaatttaaaaaatgaaataaaatcatggttcctgaacaaggccaatgacttcatctggtggtggagagaaaaatctagctgcactagaatgacattctgttggactgagactctgtcagccttcaatgtagagcctttctaaaggattttcaagggaaactctgactacttacactgttcgcctcacgtgctgacttaaaacctaaccactgtgtaagatgcaactctagtctgtggacctaaagttcagatttcaaacttaagggttaaaaattttccatggcacatttttctaaattaaaaatatacaaatagaggatgatctctataaatacaaaacatttccatgagattccaaatgcaaggccagtaattccactctaaattttctcatgaaagaaaacatacaggatggcaagattacagctgggata

SEQ ID NO: 401392 - DNA, 595 bp, Homo sapiens
atgtgtgcagctattagtaaaataaataatttataaagatttagtgggatgacatcagccagaatggtgaaataggatctatgcctgaaatcctctcctccataaaatcaacaagaacagtggcaaaaatcatcaatatcgactttttcagaactctggaaattaaccaaaggcttgcaacaatttgtagagtgtttactaaagaaaaacagctggatttttgtaacaacagcaaggtttttggcattttaacttgccatagtcctatacttttctcccagccccgtgtcagcctagataaccacagtaatcacagtgaaaaatagtgacttagcaactggtagaggggacaaaacagaatttgacccactccaaagccagacaactgttattattcgacatgtttgatagttccttggaaaatctcactcatgaggcttattgttatttagtctgacttcaaactcaccaagtatgtttgtcaaatgttcagtggcaattttaaatatcacagctatcagaggcatgtgtgggaacttaatccccaatagtaaagggattaatgccattatctggggaatgggttcattataaa

SEQ ID NO: 401393 - DNA, 405 bp, Homo sapiens
caatggagaacagctctttgcagatttatttgaagaggagagggcaatgtgccatcagatcattggcccacaacacaaccagacacatgtgtcattgctttggggtccctttgctgtgtctcccttgaggcaccatggtctttccgggaagtaacgttgaaatctgaccatgagggaaaatggacagatgatgaagagaagataagaaagcttgagtacaaacacttctggctcttccttacaggcaaccatgatgctaacagcgtacgtttcttagaaaacccatgtatctaatccaacgcttgcaagagtcttggtatggcggattttctgaaaaaggcttaatttgaagtatcattttatgtttcttaatttgaaattcaaatatacatgtatgcctataga

SEQ ID NO: 401394 - DNA, 822 bp, Homo sapiens
tggcaagcccagcacacagcggggaagttggtcttgcagaaagagtggaaagatgtgccttgaccaccagagggcatgcatttgagcagaaaatcacaggcctctgctcaaaaccaaggatagtcttgtcctaggcaacagggtaggaagagcaccaagtcctggaattaccactggccccacgatgagactctgaacatgcccgcacccctccctaggcctcctgtttaccttctgcagagcaaggaattggggccagacagcgcccaagctccattgtaccaattacgcccaatggccacagcccaccgcctggtccccaaagactgtgggagctctgtgcactgggtgtggcctctgatgtcacttctcctgaataagtggtatgtgaggctcctggactcatcacatcgtggttaagactaaggcctctggggccggactgcttgagttcaaatcccagacctatactcatcagaggcgtaggcttggacacattgcttatcctcctttgcctcagtttcctcctatcttaaatcaggctgctagccacctgccttcgtgtgaagtgcgtgaatctgcacaacgcatgtagacggtgcatggcactgagtgagcactcaataaacgtcagcctcttgacgcttttcaggcctgggactctgaatagaacttaacgaagttcatggcaggaaagggtacagagtccaagagaaaagagacaaccagacaatggagataatctgacttgatgtcattgtaaagccataaaccaggccagcgttcccctgagggtgctctgtaaaagaaagggttttgtga

SEQ ID NO: 401395 - DNA, 518 bp, Homo sapiens
ggcttttattggaggcgacagtgccagaatttcaaagacgcattttaagagactcctttatggggttccccagcaaacgctgaagccatcaacgtgaaaccagccagtgagtgtcgggatggacggcccggggccgggcagaaactccagctcagctgtgtggctctgcaggcagcagatcggcccccactgcaccgtctccagagaaccagagcaaacgcccatgtgccccgttgacagtaccgcggatgaagacactgcattgtaccaggagagttcactgttttattcattgaattttgattacgtgttatcctaaggagatacactgatttcataagcaaggcaggaagaataaaccgcaggaggaagctgctgtcatttctcaggcccggcttcgtttcaggaaacaagggttctgctcaagcacaagcaccgttcctgaagtagatgcatggaagtcattaggggagatgtctgcagcccctgagatggaagaagcctgtcgggagcggccg

SEQ ID NO: 401396 - DNA, 499 bp, Homo sapiens
agaatgttagactgtaagacacttacaatctggcattaagtctcgtttattaagataagggggggattgaagccccattgtttttattttgagaaaatgtatctaagacatgtaatattttataatgacatttggagttttcatttacgataataactttttgtaatgtcagctaattctaattgagacaatactatgttgtagtgattaggaattggaaatttttctgtgaaagaaatagcagaaggtgaaatgtatttctttgtactgtgtgtgtgtgtgtgtgcactgttttagtagcatataatcctttacgttctcatgaaactaaaaattaagggagcaatgtctaaggaattatttcatcctgggaaatatggacagatttagagcaaattcagtaattgtattcagtctttgagataggaaagtttgttataaacatcagttgggcacataatgtaaacatttaattattaaattcagaaaagtttaactt

SEQ ID NO: 401397 - DNA, 254 bp, Homo sapiens
ctaatttggaatctatatgctttttttttttgagggttactctagctattacaatatgcatacttgttatagtctgaagtcagtctcttgtcctctttctgacaatcaaagatctttacacttttataatttatatacaattgtctattttgataatatatatgtgtttctatgtgaatatatgtacatacatatctttgaagagatagtagatttgcatgtagttgtaagagttaatactgagacatcctgtg

SEQ ID NO: 401398 - DNA, 1280 bp, Homo sapiens
  misc_feature (1280)..(1280): n is a, c, g, or t
gacgaagacttcatgccatgcaaacacggggaaaatcaaaactgcccaagccaaaggatctgaaattatggcctgtcagagcttctgggttttactcttgacaaatgattaccttttaaagaaataaccggccgggcacagtggcttacccctgtaatcccagcattttgggaggccgaggtgggcggatcacctgaggttgggagttcgaggccagcctgaccaacatggagaaaccccctctctacttaaaatacaaaaaattagccggactgtcttaaaaaaaaaaaagagtccaaaccccaccccctacccccgctaatccccactcttccatcccatttgggtctgaacaggtcatcgccgcctcatttcctcggcggccaattgggggcgccagagagcagcggacgcccctccaccgactttccagcgcttgggaggcggagtgagacgccctgtaatcccagccctgcctttcgctggttgtgagctcttggccatgttactgacctctcagagcctcagcgctgggttaaaatagaactggtgtcctgataatgggtgaggccccagtggaataacgcacgtgaaatacacatactgggcgtccacttaattaaggccctatcctcattgcctgccaagttcccaaaagagggatgggtttgggtgggaggttgagaggggaggttcccggcctttccagcagtgccccctctgccgtctgggcctggcagatgcgtgttgatcccagcgttttctccagcgtgcgctcgcttgctaggtcgacgtgatcagtgagctttctccgcccgtgttctcctgagtgtcctgagagcagcccgtttctgcccctcttgcgattacaaagtcaagcccagagcctgacccacagtagtgctcaataaaggcttagaaaaagctcggaaaaaaccaaaaaacgcaaaaacaacaacacacaccacacggcgaccccgccccaaaagctcccccacaggggccccccaccacgcgaacggcgtaatcacgcggaatttactcgctgcacaaaagcggggccccccccatgcgtgaagcgctggagatctaaccacacgcaccaggagcgcccgagcgcgagacaacgattgacagacacacccacactgaatcgtgcgtcaaacactgggcaaagcctcaggggacaagtctggagagcagaaagagagcaccgaaacaatagatgactgcgggggcacaacccacggagtcgggagccgaaacttatccctcacggn

SEQ ID NO: 401399 - DNA, 1057 bp, Homo sapiens
  misc_feature (1057)..(1057): n is a, c, g, or t
gacgaagacttcatgccatgcaaacacggggaaaatcaaaactgcccaagccaaaggatctgaaattatggcctgtcagagcttctgggttttactcttgacaaatgattaccttttaaagaaataaccggccgggcacagtggcttacccctgtaatcccagcattttgggaggccgaggtgggcggatcacctgaggttgggagttcgaggccagcctgaccaacatggagaaaccccctctctacttaaaatacaaaaaattagccggactgtcttaaaaaaaaaaaagagtccaaaccccaccccctacccccgctaatccccactcttccatcccatttgggtctgaacaggtcatcgccgcctcatttcctcggcggccaattgggggcgccagagagcagcggacgcccctccaccgactttccagcgcttgggaggcggagtgagacgccctgtaatcccagccctgcctttcgctggttgtgagctcttggccatgttactgacctctcagagcctcagcgctgggttaaaatagaactggtgtcctgataatgggtcgacgtgatcagtgagctttctccgcccgtgttctcctgagtgtcctgagagcagcccgtttctgcccctcttgcgattacaaagtcaagcccagagcctgacccacagtagtgctcaataaaggcttagaaaaagctcggaaaaaaccaaaaaacgcaaaaacaacaacacacaccacacggcgaccccgccccaaaagctcccccacaggggccccccaccacgcgaacggcgtaatcacgcggaatttactcgctgcacaaaagcggggccccccccatgcgtgaagcgctggagatctaaccacacgcaccaggagcgcccgagcgcgagacaacgattgacagacacacccacactgaatcgtgcgtcaaacactgggcaaagcctcaggggacaagtctggagagcagaaagagagcaccgaaacaatagatgactgcgggggcacaacccacggagtcgggagccgaaacttatccctcacggn

SEQ ID NO: 401400 - DNA, 978 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctatggagtttctccctgtcgtccaggctggagtacaatggtgtgatctcggctcactgcagtctctgtctcctgggttcaaacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacacaaagttctggtctcccgcacgtccatcaccaaaccaagaacaatgcattcttactactacttggggcaactagcagccttacatcatcaccctaccatgaggatccccgtaagcagatcatgggccacattggaaagacccacctacaacactggagaacactataattgctatcccgtgaacctcatcgtcagacactaacgcgaagcacacccacataacacacaaaccaataccaccacaaaaacgcacggaccacaaatttcccagtaggcactgcacacccatagacactatctccacccaca

SEQ ID NO: 401401 - DNA, 1168 bp, Homo sapiens
  misc_feature (1009)..(1009): n is a, c, g, or t
  misc_feature (1019)..(1020): n is a, c, g, or t
tgcttctttctcttggacgtagttgtagctcctgtgctgggcatcttaccgtgacatccttggcacgcatttgattcactgattcattgcagtggtgaaactgacatagcttgggggccacgaggagagccaccagctgccaggaggagtcagagaagtcttgtgggaagagctgagcagtgttgcacaagctgagtttcctaggcaggaaagtggaaagcagaacctgcgtcagtggagagtcaaagcagccagcgtgttcagggagcagctgtgtggatttttgagagggccttgtgtgtgttgggccagatgaggggaagcagagaggaggacagtggtggcagactccagtgatgaaagcgaactggggagctttgccatcacatctttatgaagcattttatctttggatactggagcctatggaaggaagggtttttttggtttgttttttatttttttttgtttttgtttgtttgtttgttttttgagacggagtctcgctctgtcgcccaggctggagtgcagtggcgcgatcttggctcactgcaagctctgcctcctggattcacgccattctcctgcctcagcctcccgagtagtagctgggactacaggtgcccaccaccaagcccggctaattttatgtatttttagtagagacggggtttcaccgtgttagccaggatggtctcgatctcctgacctcatgatccgcccgcctcggcctcccaaagtgctgggattacaggcgtgagacactacgcccggcggaaggaagggtttttaagcaagggagtgttgtgatcagagttgtattttaggaagagagtactgccaacaatgttaagaaatggattagagagaagcaagactcctggcacctgtgtttgctctgtttgtaccattttactgctccataccaagagtccaagtggcacaaattctgggtccgttgtccatcacaaacaagacattgatttatatattgggactgcagtttaancctggtctannttggattgggcctaatgggtttaccacacgaacggatggttggggccgtcggcccaaaaggaaagaggaggtggcgggcatctccatgccaggagggcaaacccgggaaaacaggcgttctctccagaaagataaggggggaaagcca

SEQ ID NO: 401402 - DNA, 832 bp, Homo sapiens
atattctcactccctccccccaccccatacaacacataaaaaaacaaatctcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggcttgtgcctccaccaaaaaccgttccacgcagcataatgcgctctgcatccagagatggatggaaaaaaactgctctagcacactcagcgctccaccccgtattcttgcacaacccaccttcgtagccaaaacttttcttagcagttaccatttacatacacagacatcatacaacgatattcccttgaaccttctctgatacatattcaaatacaacccgtcactagtcaccacaccccccctataacaataatcaatacaatcccctcaccctaacaccaccagccgctgtcctccacaacaggtaacgttacatgccaaacaatatgcaaatgaaccacacattcatagacatagatcgcacaccacctttcccaatacctacctaagccattcagtatcgcgagcacctcccgccccttacactcaagcaaagcatctacactttcgtccacgcacatatcgaccacataacgtcgcggtcgcattgtgacccaacgaaaagcacctcccagcaataacacatattcactccgaactcagccgcaaaaacctcgcccaccatcatcacttatattgacacaccaactgccactcgcg

SEQ ID NO: 401403 - DNA, 2342 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctatggagtttctccctgtcgtccaggctggagtacaatggtgtgatctcggctcactgcagtctctgtctcctgggttcaaacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401404 - DNA, 2032 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401405 - DNA, 2332 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgttttactcttcagtatttttctatcagacttgtacaaataaagccttgttccaggctatacatatttaccagtca

SEQ ID NO: 401406 - DNA, 2222 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401407 - DNA, 2277 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaatatcacgtgatactacataattattccgtgccgttcttttgtgtcttgcctcttgtcg

SEQ ID NO: 401408 - DNA, 2208 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401409 - DNA, 2160 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctcccgcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401410 - DNA, 2475 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgttttaaaaaaaaaaaaaaaaaaaaaaaaaaaaaaaaaaaaaacaaaaaacaaaaaacaaaaaaaaaacgccgggggcgtatatatattatggggggcgaggagagaaaaaaagaggggggtataaacaggggagcagggggggcatagaagtggttgcgggcgcagcactgtttttgtgcaccaaagggggggaaatctgggggggtcccactataaaggaggggagcatatactattcagtaaaagagcggagaataaggaggtaataaaa

SEQ ID NO: 401411 - DNA, 1580 bp, Homo sapiens
agggctgagcatgggtcaccaccatagggaatcaaacgacgctgagtcgtgtgtcctcgcagtgagcctgggcagctcatgccgacctgcttccaaggcctggtcccagtaggccactttaccctcagaagccctgtgtccttgtctgtagaatgagggttatgtgcgatcatgcatatatattggctacacatagtgaacattgaaaaatttgtacctggtataacttttaagtatcagattccatattgaaatgaaaattggtttttttgtaaacagttttgacctttgccacaaggctcacatgaagaacatttggggcccagggataagcggcaatgtcagcgccctcaggtttctgcgttttctctgcctgcaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401412 - DNA, 2627 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacagaccaatgaatgactgcaagcccatgaagccaacactgacgaagttgcagtatgcagcgccgtgcctcgcctcgcctcgcctcaccattgcctccactcacgccagaacaagtgtctatcctagcacagtcttttccagagtctcagtgtcctaccagcattctcattttgtcctccacatgtttattggtcacttttgatcttcacattcagccttctctaactggtgctgggcaccgggtgtgtcaggctctgtgttggggggaagcaagccaggcctggtgccagccctcaagggagctcaccgtctatgagggagaccagatccatgcaaggccctaacccagtacccaactcatgcaagtacctagtgccagtccttagagcagaggagacctgtaaacattcattcctgtactttaacaacttgacatcaggagattttacattgaaactttctcttcctgtggatgttagatcggatcaggtgctcatggtgagttctgatgcttctcatcccagtagctggactacagagacaggaagcagcctgcagagaaaatgaagtagtccagggtttcagtgtgagttaatgtgtgttgtggctaatgtggtgctttcgatagggagagagatgggctgaccatctataataccattatttatatagtcatcagagttgtgtatttgctaaactttataaatacatgtgtattttagaacaacacagtctttttgttagaatgttatgctcaccatttacgctgccctccataggagaatagtggtcctgagaggtcatgtttattgagcgctggtcatgtgcccgtcactgttctgggcttctcacatgcatcctttcatctcccaaattgcgaggaaacagagagtcaaagcctggtcccctgcatgtggtcacacggggccaactccaaagctcgggtctccctgccaccctgcgctgaggtcagacctaagacagcatgcagcttcccctgcatttttatttcacggaagcatgaacctggttttctgtccctacaagttgagtatcccttatccaaaatgcatgctgctctagtccttcagtaagcccatcacatattttctctgtgtcgtctgtagacactttttctgcagcgttagcatcatctccatcatcactgttgtcacagtcaccttgactcagaaccatctcagctatttcaccatgggtcagttaatgaacagctggagcccccttatcgatattaaaaacttcaatatctggctgggctcagtggctcatgcctgtaattccagcaagttgggaggccgaggtgggcagatcacttgaggtcaggagttcgagaccagcctggccaacatagtgaaaccccatctctactaaaaacacaaaaattagccaggcatggtggcacatgcctgtagtcccagctacttgggaggctgaggcaggagaatggcttgaacccaggaggtggaggttgcagtgagccgagatcacatcactgcactccaacctgggtgactgagcaagactctgtctcaaaaataaaataaaaaa

SEQ ID NO: 401413 - DNA, 298 bp, Homo sapiens
aagcaagggagtgttgtgatcagagttgtattttaggaagagagtactgccaacaatgttaagaaatggattagagagaagcaagactgtaagtagaaagacacataagacttttgaatctgtcaaggtgaaggtgtcaaattgacattcagaaccaggtgaggggtgggcaggcagttttaggtctcacttcattttcttagcccaagctatagaaagggttgagattgtatgaggagatgagagagcaagaagaaaaggctataatggaaccatggagaagccagaagagtggtgt

SEQ ID NO: 401414 - DNA, 2262 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401415 - DNA, 1895 bp, Homo sapiens
gtcgagaggctgcctgagtcagaggctgtatgtcattaggttcttctaacgtctaaagtgctgtgagtatggaggaacattgtcagacacaagaaagagcatcaagcaagtcagctgaattctttgggccgccacctcactgtgtataaaataaagcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401416 - DNA, 2618 bp, Homo sapiens
tgcttctttctcttggacgtagttgtagctcctgtgctgggcatcttaccgtgacatccttggcacgcatttgattcactgattcattgcagtggtgaaactgacatagcttgggggccacgaggagagccaccagctgccaggaggagtcagagaagtcttgtgggaagagctgagcagtgttgcacaagctgagtttcctaggcaggaaagtggaaagcagaacctgcgtcagtggagagtcaaagcagccagcgtgttcagggagcagctgtgtggatttttgagagggccttgtgtgtgttgggccagatgaggggaagcagagaggaggacagtggtggcagactccagtgatgaaagcgaactggggagctttgccatcacatctttatgaagcattttatctttggatactggagcctatggaaggaagggtttttttggtttgttttttatttttttttgtttttgtttgtttgtttgttttttgagacggagtctcgctctgtcgcccaggctggagtgcagtggcgcgatcttggctcactgcaagctctgcctcctggattcacgccattctcctgcctcagcctcccgagtagtagctgggactacaggtgcccaccaccaagcccggctaattttatgtatttttagtagagacggggtttcaccgtgttagccaggatggtctcgatctcctgacctcatgatccgcccgcctcggcctcccaaagtgctgggattacaggcgtgagacactacgcccggcggaaggaagggtttttaagcaagggagtgttgtgatcagagttgtattttaggaagagagtactgccaacaatgttaagaaatggattagagagaagcaagactcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401417 - DNA, 1860 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttta

SEQ ID NO: 401418 - DNA, 2529 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgttttaaaaaaaaaaaaaaaaaaaaaaaaaaaaaaaaaaaaaacaaaaaacaaaaaacaaaaaaaaaacgccgggggcgtatatatattatggggggcgaggagagaaaaaaagaggggggtataaacaggggagcagggggggcatagaagtggttgcgggcgcagcactgtttttgtgcaccaaagggggggaaatctgggggggtcccactataaaggaggggagcatatactattcagtaaaagagcggagaataaggaggtaataaaa

SEQ ID NO: 401419 - DNA, 2101 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccggagttagccactaggctgcgggtgaaatgggatggagtagaacaacagcaggcttcctggagccacatgggctgactagggcactctgtggctggcctggcacgggctcagcccaggaagaggagaaacgatcccttgcctgcccctcccttccaggccagaggactctgcagtaccttctcctacatctagtaacaaagaatggtgataaccatgcactggttcaaggttctggagttctccatgaaacttgggttaattttgctcagagtatccagagttagccac

SEQ ID NO: 401420 - DNA, 1471 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttaaacacattcaaaacgagtgctgactctccaacctagggaaaatgcccaataaaaaatatagatagaaaat

SEQ ID NO: 401421 - DNA, 1201 bp, Homo sapiens
cgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtaattaatcagtaatacctggtactcattctaaatccatgtttcagagttgaagcagtttcgatcaacaggactcaaaagtaatcaagcgtgtaaatacaaagatggtgacagcagtccatctgccaccatgatagaga

SEQ ID NO: 401422 - DNA, 540 bp, Homo sapiens
cagtctccagaattcgctgctatcacaccaagtcatgctgttgccctgtgacctcacacttcccattccatggccttgtcttggcagggagtaaaaaatcccacttctttttactttagtgggtctcaactgcagcatttcagaaacaaattttgatttgacactcaggagaataaaaacaagttgagggcagaatgtatttggaaaagcttaagacaaatttactgatattattttatgatcatttaggattacagatcaatttacctccataaatctttgaattgtcactgtgaccacaggatgaaaatcctttattagccattttataggttaaaacaaaaaattgactacacagccgacttccctcagataactatgaagtctattatgagtactgaatgaccaaagaacatggaaaaaatgcatatgaataaatactgaaatgtttatgaaagatatttatgaaagatattaagacttctgtgtttaggtatgcacatatgataaaataaatctaaaaacattaaaaaaaactaa

SEQ ID NO: 401423 - DNA, 597 bp, Homo sapiens
gatgacagtgacagtggagaactgaagtctataaaagttaagacctagatctagatgctcctgaatttcccctttttattcttaacaacacttcctttgtgctgtgatctcaagcaactgagcctaggtctttttattcttgtctgatataacagaaggtagaggatgaaataaatgagtttattaggtaacacattttgaaaattgtgtttaagatttagatgatatattttagaacttctaataaattcagaggaattcaatgtcaaaggaaacttttgtatagttatacattgcttaatgtttatacatacatccatgtagcatacttctaataatatctttaattatactagttattttaaaataacccacaaatactcaaggaattgttcagtttgtgaactgtgtgagaactacagtttttcatggtaacatttatttgtgtggtttttaaaagtgatcacaggacatctcatctagatgaataattagaataaatacttgtctcttggagacgattttgggtgtagtctttactagaggcataggtatggactccaagttggctctaatattatgagatacccttgagta

SEQ ID NO: 401424 - DNA, 591 bp, Homo sapiens
ttaagatttcaacaagacacagtgtctcatcacataatgcaaagtacaaccccaaaatattcagcatatgaagaaccaggacaatcttaattcacttggcaaagagaatcctcgaataacaatactgagaagacacagatgttacaatcatctgacacatacttttaaatagttattacaacaatgatccatgaatgaaaggataacactcttgaagtgaatggaaaattgggaagtcttagcaagtatctggaagctctaaacactgattttaacttaaaaattaaaaaatgtattcatcaaaactattaggagaaaaaaagcttcaatgggttatttcaataacaaaattgagacactcagaataaagtcaatgaacttgaaaacacaacaaaaataccaacctaacctgaacaataaagaaaaatgagtgcttttgcaaatgaacagagcctccgggacaaacagaaaaataagaaaaatctaacacatcattgtaatcctgcaggaagaagagaaagaggtcctccagaaagaaaactccgaagaattaatggctgaaaacatatcaaatttatcaaaacactttag

SEQ ID NO: 401425 - DNA, 476 bp, Homo sapiens
ctcccagaaggcaaagattacatcttcttgtacttcttattcccaggatccaggatagaattatctcaaattctaaattagttgtgtgtgacttcatgaaatttttttctttgagaagagaaactcctttggttaaaggacacacagctttctgactatactgctgtttggaaggggtgtgttttttaaaatgttaattagaatttatttggctttcgaaaattcataaacataatggaaacagaaatgacacaggaggcttcagaccacatccctttaaggtaactactctgcccacctgctttcccacaggctcagtgtggccagagctgactgcgaggctggctttatgctgctgctgtggtgggacctgggccccataacctgtaccctcctgaagggaggcccacagtgccagtccacaggtcgatgcagccttggttcgctgcctctggtgctgactgcaggggcctggc

SEQ ID NO: 401426 - DNA, 233 bp, Homo sapiens
tcttcattcacaattccaccctcctcatgcaatccacatcatacacattcacagaaataactcccaccacacagcacttcaacaagaatatccatctagtgaaagccaactgtaggcgtactttctcctatttacttttctctctcattcacatataccccagcttacatacagctccattcacatacacttatgtaaatacacatgtgtgcacatcaaaacaccatcactca

SEQ ID NO: 401427 - DNA, 428 bp, Homo sapiens
aaaagccttctcggttcccctagttgaaataagtcttcttccctcttccaggttcctttagcacttactatctctcttataacttgtttcatagtcatccttatttcagatttatttgtgtgtgtatgtcctgcaggaacatggagtgtaggaatctcacttccatcccactccatagcagccagcccagtcctcagcccatctattcagtgggtgctcagtctgtctttgtttaatcacttgaatttgaatgtgagaagggacttcagaacagccattcatatccctttgtaaagagttctgaactcttgcttaatcattgttgactgactcctctacatggcaaagcagaggaaaccttatgtctttcttgagttaaaattaccataccttgttataattctctatttctgtaatgttggcccaca

SEQ ID NO: 401428 - DNA, 2364 bp, Homo sapiens
  misc_feature (883)..(883): n is a, c, g, or t
  misc_feature (916)..(916): n is a, c, g, or t
  misc_feature (1085)..(1085): n is a, c, g, or t
  misc_feature (1182)..(1182): n is a, c, g, or t
  misc_feature (1245)..(1245): n is a, c, g, or t
  misc_feature (1388)..(1388): n is a, c, g, or t
  misc_feature (1629)..(1629): n is a, c, g, or t
  misc_feature (1744)..(1744): n is a, c, g, or t
  misc_feature (1803)..(1803): n is a, c, g, or t
ctgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaaccctcgtgccgaattcggcacgaggggtgagccgagatcgtgccattgcacnctagcctgggcaacaagagtgaaactccgtctnaaaacaaaaccaaaccaaagtactgggattataggcatgagccactgtcccgcccttacgtttgtttgtgtgttttttttttttttgagacagtgtatcgctctgtcccccaggctggagtgcagtggcacaatctcggttcactgcaacctccacctccagggttcangcgattctcctgccttaacctcccgactagctgtgactacaggtgcctgccaccacgcccggctaatttttgtatttttagtagagatggggtttcnccatattagccaggctggtcttgaactcctgaccttgtgatctgcctgcctcggcctcccaanatgctgggattacaggcgtgagccactgcacccggccacattttttttcccctcattttcacacacacaaaactaacagtaatcccttaatatttttaatgttgaaatatcccaaagactttttttttttttttttttttganatggagtctcactgtgtctcccaggctggagtgtggtggcatgatctctgcttactgcaacctctgccttccgggctcaagagattctcctgcctcagcctgccaagtagctgggaatacaggcgtgtgccactatgcccagctaatttttatgttgttaacagagatggagtttcaccatgttggccaggctggtcttgaactcctgacctcaggtgatctgcccacctcagcatcccanagtattgggattacaggcatgagccactgcactcagtcccttgtttttaaaagcaataaaggttagtgggggccgggtgcggtggctcacacctgtaattccagcactttgggangcttaggtgggcagatcacttgagctgaggagttcgagactagcctcggcaatgtggcnaaaccccgcctctataaaaaatacaaaaatgaggaaggggtggtggcacgtgcctgtagtcccagcactgggggagctgaggtggggaggatggtttgagcctgggaggcaaaggttgcagtgagccaggatcatgccgcttcactccaacctgggccacagaaacagaccctgtcttaaaaaaaaaaaaagagggtagtgggttttggaggaaggaggtcttgcttctgaagtcccagctcttctatctagccaggtgactttgggcaagttgtttattgtttatactccttcgtaaaatactgctgacttctctgcattgttgggaatgagatgtttgtcaaggatttagcatgtggtgataaatcagtaaatgttgaatatttcctggtattaataataaaggctaggaataaaaattcatacttaaaggaaaatggacttttatttatttatttatttttgagacagaaatcgcttgaacccgggaggcggaggttgcagtgagctgagattgcaccactgcaccccagcctgggcgacagagcgcaactccatctc

SEQ ID NO: 401429 - DNA, 343 bp, Homo sapiens
ttttatttttatttttagtagagatgaagtctcactatgttgcccagggtggtcttgaactcctggacttaagtgatcctcctgcctcaggctcccaaagtgctgagattataggcgtgagccaccatgctcagcctcaaacactttccacttcgtctctctcttttatcaggcctttggctttggattttctttctgtagctgctctttctattccttgaatgattcagccagctctcctctaacacttcggctagttaggtgcatctctttgcaaagggaactcattttttcctccggtgtatatatttttaaacttttcattatggaaaatttcacatat

SEQ ID NO: 401430 - DNA, 311 bp, Homo sapiens
ctgtaattgggctaatacctataaggcacaggatgattctgactcccatgattcagagcatgttgagcttagcatggtcttatgtattaatagtttaaaaacacagtgaatgaacacaatcctaatgaacaatttctaaagatggacagagcacttcacctggtaattacttttcacatcctttcattcacgtactcacttgctgcacagctactatctcctcactcgtgagtattattcctcacttatctgtctgttgagcaagaacaacgcagacactaaacaccctgatgctgcttggtcctgaagaa

SEQ ID NO: 401431 - DNA, 393 bp, Homo sapiens
atctcaaactaatatctacctataaataaagaatagtatagaactccctcggaagctgacataagggttcaacccactgaaatgcaacaccaatgaggtatgttacagaatttggcagaattgtaccagtcttttatggttccaaggtctgggctaatagaactttaaccaagatttggggttttaggtttcctctttcttatccttcagacatgacatcacttgggcatattttttctatcaattaaactcataaaatatatgatgctaaaaaaaggggccaggcagttttctgactgtctctacagccaaaagaaatagagctgaaacagctgaatccagataattcaaaggagaggtagagggatcaagaagagaaagagggaaagaaag

SEQ ID NO: 401432 - DNA, 727 bp, Homo sapiens
cccagccaccttttcctcatccaataatactcgaagctgtcattgggtgattttgaggattaaatgagaaagcatttagcccagtgcctcatgcagagaaggtgcttttttttctattaactttacaagcagtaatgctgaaccttagtcagtgtctttctctgtaatatacatgtgagccaatcaggtagaatctcagtggcacccagggctggctcacagaatgtgtctgtctagtgaatgttggttcagtgaaggaactttgcatcaggtggttcggcaggtgtatttctgttccagtttcaaaccaggtgactacgtgttaggacgtagcaatctgaagcccttctgaaaggaacatgttttattaaaagtgccttgtaagccaccatgtcaaatctagccaagatgctggtggacaacccattagtcactttattcagagatcagattctaactgcccatagggctgaaatctttggccagattttcccaggaggagccctcagagaacagtggcccaggtgcccaacaggaccctacacagtcggtttctttccttgttcggggacagacagagcgattggcgatagctgttaccatctcacttaaaaatacttgagcaagttattttccctcctcgggagctcttagacaagcaagttcttacttaacaacaaaaaatgctttgcttcattccttttctccttgatcttatatttccatt

SEQ ID NO: 401433 - DNA, 701 bp, Homo sapiens
cagataaaagtgatggcttctagagggaaagaatctgtttttcattataaatcatggtttcgcttttaactattaagcaattaaaaatataatacaattttaaagaaataagaacaattctacaagtatccacacagaaaagaaggatgaaaaaaggaaaactaaaccaaaggtctcagaatcctcctctgggagactggaatttccaaaattggaatggccacaataattatctcccacatgagctgtcctataatgtgactttgctgctactccctgcacatggagatgaaatctattctcccccattagaatatgtgtgggccatgtgactgttctgaccaataggatacagtataagtgatgtggtgagttctaggtatagcccttaactagtttggcaggttgctgcctcggagccacaaactgctatgtaagaagtccaggctactttgctgaagagacaggccaaatagaagggcaaggagtttccagacacatgagtgaaaaagacatcttgaatatctggccagccaagctttaagatgtttgttacacagcaggaaataaccagaacatcaccagcaacaaggaatgctagaacagaatgtagcaatgtccacaaagactagaaggaaagggatatgagctgagaattctgtacacagcctcgacatgttcggggtcctctagagtaacct

SEQ ID NO: 401434 - DNA, 479 bp, Homo sapiens
ctctccccaaatcttatgaaagttagagtttatcaaagaagatgattcttcagaggaatttaagagtagaaagcactgaggcatatcctacccccaccacaaaccaagtgaggaaatccccaaaagcatcattcagaaatagttgatagtgggacacatgctagcagagctgaagcagtttgtaggaatctctgttgttgtaggaatctctctgttgctgtctgtgtagagagacttcttgggaggactagacacatgatctatgagaactgcagaaatctcagcacataatgactctatctaagcctctgcattaagagaggaccacagtctagcatgatctctagcagcatgaggccctgtccctaggatgaccccagttcccctgcccctccattgaaatgcctacctgagaaagctcaatactgccaggtgaatttatttgcttcagccatgcctgaagacaggcctctgacctc

SEQ ID NO: 401435 - DNA, 456 bp, Homo sapiens
cgcagcacagcgtagtccaaatgccagaaacctggcaacaacgatatcgtgcgggagtcggtccgagatgtcccagggaatctgaacgtcttcccagccgctcaggatgtctctgattgtcatgatccccattagaacgtctcagaaactgccaaccaccatggcttccatgaagccccaagaatccttcagcaaagctccatgttgcaaactaaagcccagggtgtgcatcatgaagacgccatccctgtgtcccgggttcagaggcttgtacccgggactcgggcatgagaccccattacgggcctgagcacagcaccaagaccgtcaaacgctaaaaacaggcacaggtggaagtctcacgtggcccgcccccccgcatctagacttgtgttttacagtaaatgacgaaatgcagtccagatacctaaaagatgaaaactaatctttgtgatt

SEQ ID NO: 401436 - DNA, 466 bp, Homo sapiens
tggtggcacttgcggctgcagttgtttaccctgagataactttgccacgaaatatctcgcttttattattatttttacatcactgtagtatatcaactttggaaacaaaagacatcattctgtccatagcattctgtttttagtagtggtatttccatttacacaaacaaaaatcgagaaaatttgacagagaattactatactcaatcgctgaaaatgtcagatccttagaaaacatagcattcttatgcatgatgttaacatcgtactcaaatacttgatgcctagaggttcattcgatgaatccaggttttttgaaatagatgtttctgatgattcagacaattctgatgttaattctctttagaaataactcccaagaagagttttatattttattttcacagtaaaaatcagtcagatttgcagtagccttgaagagagtgttcatgtaaaattaaatgcg

SEQ ID NO: 401437 - DNA, 546 bp, Homo sapiens
  misc_feature (404)..(405): n is a, c, g, or t
  misc_feature (407)..(407): n is a, c, g, or t
caaactcttgaccttgtgatccgcccacctcggcctcccaaagtgctgggattacaggcatgagtcaccacgcccagccagatacagatatataaattttatataagttaatattatatataattgtatttatatagttatgcagtaaaatataaatattcatgttattttatttaataatgtatattttatattatctgtttataattatacatttatatatttgatattgttatacaaatatgtggttatataatatggtatagatataaatataaatttatttttactgtgtaatatagaaatagatataattttatttctcctaaccactctgaaatatatatatgtgtgtgtgtgtgtatatatatgtgtgtgtgtgtgtatatatatatactcacgcnnanaaaaaatttttatagagatattttttaatatattattaattaatttatttattatggtaaactaaattattttatattttaaatatgtaattaaattgtttaataattataaaatatttacgtttgatatggtttagaa

SEQ ID NO: 401438 - DNA, 215 bp, Homo sapiens
atttgaaatgcttcacatttaatagttagttgattgtcatcatatctctatcagtaggcgtattatcattcctgtttctaaatgtgagcatgcagcaggcaatgccagtgtaaacactgaacaatccattacataatcatccctgttaatgttttatgcaggtaaatgtatagaggaaaagaaagatgggaaaaagaaaaaaaggaagtggaaag

SEQ ID NO: 401439 - DNA, 438 bp, Homo sapiens
ctgtaaacacatactgtctagtacctttggcttattttaatttaataatatatctcacatcacattcttctgaaagaagtataaaaggaaaaaaaaacatacctaggtgatcagaccatatcaacatatctggagctaatttcttaaaatttggcaaattcggccgggtgcggtggctctcgcctgtaatcccagcactttgggaggccaaggcgggcagatcacaaggtcaggagtttgagaccagcctggccaacatggtgaaaccccgtctctactaaaaatacaaaaattaggcgtggtggcgggctcctgcaatcccagctgcctgggatgctgaagcaggaaaatcgcttgaacccgggaggtggaagttgcagtcagctgagatcatgctactgcacttcagcctgggtgacagagtgagactctgtctca

SEQ ID NO: 401440 - DNA, 503 bp, Homo sapiens
tgggcccctaggaaacctggatgttgtttccctgttagtctgagttcagaaatactcccatgtcaccaactctgtctttgttcttattataaaattattactaatgagagcggccatttatgaagtcagttctctgagccaggcgctgggcgaggcactttgcattcatctcagtcttgacaacagtccggtggaggtaggaggtcttgaccccgttgacagtgaggagtggagacttaccaggtgacacaagtgctgttcatcaaacagctgttgaacgatgagactgggagtgagaccagctttgttcacctacgaaatctatgccttccacaaagccatttccactgggatctgagaggtgcctccggtaccactgtatagtgagccccatggcctaggtttccactgggaagaccccagctccagccctccttcctttcctgtctgggtccttcccaagctctgcaagaggatgtgcagggtcagctgtgcagagtgtg

SEQ ID NO: 401441 - DNA, 138 bp, Homo sapiens
agagttaatggtaatggaccagaatgatagcagtggagctgggaattctggatccattttgaaagcagaagaaaaacaaacaaataggctttcctgatgcattggctgtggggtatgagaggatgagagaagtcaagg

SEQ ID NO: 401442 - DNA, 219 bp, Homo sapiens
agggtttcaccatgttcaggctggtctcgaacgccagacttcaagcgatccacccacttcagcttcccaaagtgttgggattacaggcgtgagccactgcacccagcctggatttttttttcaagctaacaatatgctatctacaaaactttcaacacaaagatacaggtttgacaactaaagggagacagcatatacactaggcaaaaaggcatgaga

SEQ ID NO: 401443 - DNA, 237 bp, Homo sapiens
acatttctgaaatctggatgtgtcttataattggtggcatccttcgattataattggcaccactcttttccctttcttaatggtacataaactaatagtacatcttatgactgaacagcatcttacattcaaggacaagtgccatgtctccatctaaatccatcatgttatctctaagctgatagaatattacatagccattaaaactatcataagacagactttaatttatttcac

SEQ ID NO: 401444 - DNA, 3210 bp, Homo sapiens
ggcacgaggcaacaacacggccctggtcgtcgtcgccgctgcggtaacggagcggtttgggtggcggagcctgcgttcgcgccttcccactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacat

SEQ ID NO: 401445 - DNA, 1349 bp, Homo sapiens
gcctggaactgcaggatacactcccctcctgctacctaggcaggcgtgagggtgtgacggccgcgcattcgccagacgagagcgatggctgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggcagagaacagcattgacttcgtcagcagggagctgtgtgcgcattccatcaggaagctgcaggcccatgtcctgttgatcaaagcagtccacggatattttgatccaagagagaattactctgacaaggagtccctgtctatcatgatagacacaatgaaatccaccctcaaagaggactacttcggatacaatcacagcaaccctggcctcggccctgccctgtccctgccatgcaacttcacaactcagctggcctagacccctgggaggcctccaagtccctaagcggttccagtttgtggaagtcccaggcaatcactgtgtccacatgagcgaaccccagcacgtggccagtatcatcagctccttcttacagtgcacacacacgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctgtctcctggctaataatctccagccagctggaggaaggaagggcgggctgggcccacctagcctttccctgctgcccaactggatggaaaataaaaggttcttgtattctca

SEQ ID NO: 401446 - DNA, 403 bp, Homo sapiens
gtatgcagctggggagggagtgagggaatgtcacccacagctcttttgtcccccaggtggcgtcgtgggcggaatggtgagtagatggctttgtctggccaactggggctcccttgggtggagtggggaggggagcacaaaggaggaaggagaaggtacctgggacagaaagtgcctcctcctgtcacagtgatagtccttataccaggaagttggtgtaaacggtggagactcctggtagagttcatgtttccacgcccccatacccggtcccaccgcaccctggagtccagccatcaccaaggtctggagctcagtgctgggtgcagacttaggggtggtgggggaaggcacaccatagatagaagattctcctctggcctcttggtcagcaccctccccc

SEQ ID NO: 401447 - DNA, 1206 bp, Homo sapiens
agctaatagtcacactttttttttttttttgagatggagtctcactctgtcgctcaggctggagtgcagtgggaagatctcagcttactgtaacctccacctcccgggttcaagcgactctcgtgcctcagcctcctgagtagctgggattacaggcacctgccaccatgcccagctaatttttatatttttaagagatgggggttcaccatgttggccaggctggtctcaaactcctgacctcaggcgatccgcccaccttggcctcccaaagtgctggttttgcagatgggagccaccatgcccagcctagtctcactttataggctcccaaaccacagcagaacacctggctgcctcatccctctgcacccatcacgccagtgggcatgctggctgtaggtggggatggcctttgcccgggttcctgggagcacctggtgttttatggtcacctacccacttacacctgaccctggggcctctgcagttttcttggcgttgtcaccacaaaaggaagaagcccacctgtggctggctggctggccgccaggtcagagccaaggcaggcagggccttcctgtctggcttcttgaaggcagacacaagtctgcaggctgctcacgtcatctcattatcttttctcacgaggactacttcggatacaatcacagcaaccctggcctcggccctgccctgtccctgccatgcaacttcacaactcagctggcctagacccctgggaggcctccaagtccctaagcggttccagtttgtggaagtcccaggcaatcactgtgtccacatgagcgaaccccagcacgtggccagtatcatcagctccttcttacagtgcacacacacgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctgtctcctggctaataatctccagccagctggaggaaggaagggcgggctgggcccacctagcctttccctgctgcccaactggatggaaaataaaaggttcttgtattctca

SEQ ID NO: 401448 - DNA, 1080 bp, Homo sapiens
atgagtgagaacgccgcaccagacttttattacgttgccatggatttcggaggtcatgggctctcgtcccattacagcccaggtgtcccatattacctccagacttttgtgagtgagatccgaagagttgtggcaggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagagggagacagagtctgggttcgagggctgctttctcctggctaataataaatatccagccagctggaggaaggaagggcaggctgggcccacctagcctttccctgctgcccaactggatggaaaataaaaggttcttgtattctca

SEQ ID NO: 401449 - DNA, 233 bp, Homo sapiens
tttggaacagagacaagatgtattacaaatcttaactcactcaaaaatcaggtagtaacttgtttgcctttgaggccctgatctcctggattcttctattaatataaaaggatctctgagatcatggcttgttgtagtagcactttccattttaacattatattctccaaccggtaagattagctagtaaggaaatgtgatatagggcaagttcttttctgcagggggagtgt

SEQ ID NO: 401450 - DNA, 430 bp, Homo sapiens
aaacggacctgtgccccctccagtggaaccgcaggctcaaggcggggattgtgcattcgctctccccaagtcagcctcccccactcctgaatggctcctttgtgttgcattttacacagttctgaccttgggccgtgagttggatatgaactagaaatgtctggtttgtctctttccttcttaaattaatggcctttacccccggtgaaactgctttttatttggcagtttcgcttaattttgcctttccgcgggtctttatttatgcaacatcgccgcccgatggttagaattgggaacagagtcaaagatggaagtactgtaataccaaagacgcaagtcagcagagatcaaactaacaaaggagaatgcagtcacactttacagacgtgagattagaaattaaagtaggcaatgaggtccaacttgt

SEQ ID NO: 401451 - DNA, 349 bp, Homo sapiens
atatacgaatcgagctcgtgtaccctccataaggtcaaaacagtggtttagagagacgaagtaacttcctcaaggttacagttagtaaatatcccagttaggattcaaagcaagctttttttgctttagaattcttccccaggtcactgcctcttccatcaacttcaactatttataaattctcccaagttccccaagggagttagatttgaatgatgtaaagagcagaaacataggactgactgaatgattctcatttggcccttatcgagtgaggcaccagcgtcgtggtgtagagtgggttctcatggcacgcgtaacctcaccaggggctccaattatcaaaatt

SEQ ID NO: 401452 - DNA, 369 bp, Homo sapiens
aagatttgattatttctttctagtggagcaagaataataactcccagaaaataacatctatatctttacacttgtatctatgtctctttggatctatatcaatatctcatttatatatggcacatatctcacatacacacatatacagagagagagagatgtgcagcctgtgctctaaacattcatttgtgagttggctttttaatctgtatacatccagttttgttattgatggctgatcccaggacagcttataagggctccttgataactactgttgtaagtatactataccgtatagggaaaaatgaagtcaacttccaattctggatcccagaacaatatcttccccttttccagcagcaggat

SEQ ID NO: 401453 - DNA, 189 bp, Homo sapiens
ccacctggactctgggcccctcccacctgggctccgggcagcaacagtcgcccgccccaggtttgggcttatgcctgtgccgtatctcctggtttaatttgcattttctcaagggctaatgacatggagcatttttaatacattgttggccatttgtctttggtgatatgtgtgttcaaatcttttgcc

SEQ ID NO: 401454 - DNA, 144 bp, Homo sapiens
cctcggcttcccaatcccctcggctgggattacaggtgtgagccaccacacccagcccctttattttctttatggcatttatcacagtttgaaatctttgccatttattgatgtccttgcctgtctctgcacagctgtctgcac

SEQ ID NO: 401455 - DNA, 477 bp, Homo sapiens
  misc_feature (1)..(1): n is a, c, g, or t
ncagaggacacggtcattagggtcatgtatatagtgtatatgtgtataattttctagtattattttatgttttaaaatattagtttagccccgtttaattctgtagttaggtatttgaaatgctcattatcttgttgaattagatttttctctttaggaaatgaactcaatgctgtatgttcattttggtagctattaaaataatgtgaactgctaacaggcacacttcttttgtatcaaggttaaatcagaggtactgatgcgctgttccttcccaggctgaagaattgagaatatttgatggtgatgaatgtttcttaatgaaaatgtaaactgagaaagggaatctaagctgactttatgttttacttatataatttttttgttttaaaggtcatattgactgtaaagcttttctcatgcggaaatatggatgatctgtatagaaaggttttggcattaagatatatgtacaga

SEQ ID NO: 401456 - DNA, 463 bp, Homo sapiens
agcgtgctgttgtccgtcctttcttctcttggtgccagtgacctgaggtgtaactggggtatctgagctgatgtctgccacctgcagttcatccggtgagccaggttgtgtccctgttttatagatgtgaacactgatgttctgagtggctcaggagctgcagacagagggggccaagcaccagcacgtggccttgcaccttggctcacagtccacctggctgttgttagaagtattgctagagaggccctagctggtaccatcccagcctcatagccccagactccctctccaactggaggaccacagctctgtcctaatccaggccccaggccctgcagctgtaccctcaagaagtctagggcagggcacatccagaggtccttggagggagggcctcaagctgcttttgcccatccaggtttccacatcctaatctttgcttttcttgtcctttatgcca

SEQ ID NO: 401457 - DNA, 1351 bp, Homo sapiens
  misc_feature (4)..(5): n is a, c, g, or t
  misc_feature (7)..(8): n is a, c, g, or t
ggcnngnngctccgcccgcggccgggatgcactaggcaaagccagctgggctcctgagtccggtgggtacttggagaacttactacgtctagctggaggattgtaaatgcaccaatcagcatgctgtgtctagctcaagattttctccatccccttattttgggccagtggctgtcattacatatgagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtggctcacgcctgtaataccagcactttgggaggctgaggcaggcggatcacttgaggtcaggagtttgaaactagcctggccaacgtggcaaaactccatctctattaaaaatacaaaaattagccaagcatagtggtgcatgcctgtagtcccagctacttgggatgctgaggcaggaagaattgcttgaacctgggaggcagagtctacagtgagccgagatcatgccactgcactccagcctgggcaacacagtgagactccatctc

SEQ ID NO: 401458 - DNA, 638 bp, Homo sapiens
aggcgtgagccaccacacctagtctttaccaaattattaatctctccaagctgtaccctcctcatcttttaaaggagttgaaattaaacctttcttatgaagtagtgagagagaactaaatgagaaacaccatgttaaaatagtgcagttctgattttttgtagctcgtaatttcgtttgtattgatactgatttctgtatctgggaattaggttactgaacatgtattgctacttgagttgctttgtgctcgaattatatcagtagataagaaaataaataattaaaatttattgttttatgggatgggaaaaggaaagtcattattttaagcaagatatcaaatgcttaatctgtttgtgatatttgggggtttttagctattaaacacctttatttttgaaaattctgcagaaaaaaattattcaacagatactcggtttcagctgtgtatcagggaaacatgcagaatgacatggtttcctgcacagtcaaacttgcattcagttggggcaagaaaaaaataatgaaacattaaaaaaaaaaaaagataagtgatattaacacaaagggcttccctaaagaaaaaacagaaggctacctaggatgactaggcaatgccttttaaatatggaact

SEQ ID NO: 401459 - DNA, 747 bp, Homo sapiens
tcaataagattatctttactttttgagttccttttcaggatttagaataattttgttaaagggggacgtgaaataattataattttaatttatttgaaaagacatataattgtattttaggcactgtaattaagttcactattttaaagttaggctataaaaatgaactcaatatatttgcatataataaaatgtaagaagtatattagctcttgtttcttaaaatacaaatatatattggcttttgaaacatttagaatgtaatagctcatgctatccatttccttatattctgaatattttaaatcagaaatcaagtctcattgagttttccaattctcacacaaatacaagttctaaactttcctgtagaatttagaagtaaattatttgactacttttttcacgctcaaacatttctaaaattttaactaacctcattagtatttatatcttacccctcttaaaaaggaaatttcatgtaattattatttttatatagatttttaatgttttactataatacagacttatttttaagctctagctgaaaaatacctcttagctcagatatttatttttttacttggtacctcttagtttagatgttcatttttttacttagtagcttttatagtataaactattagtcaaagaatatggtcatgtttaaaataaggtatattatttattgaatacaagcaatagttcaatgatttaagttctatatttatcttctcagagtaa

SEQ ID NO: 401460 - DNA, 421 bp, Homo sapiens
gactctggacagaagttatagctccacggtctggacgcagccacctccccaccgggccacctgctccgatcctatgtggaagtcatgggccactaagagagcctagagtggcacagtcttgactctgaatctttaaaaacttcaggactccttgacttctcatttctagcattcagacttttaatttttaatgggatgaggcccaaaccaatttaataatataaatgacgactgattttaaagatctctgagcatttagaatttttgccattgggacatttttatggaaggaaggaacttaggcataggtctagtttcaggtcatgtaaaaatgctggcctattaagaagttaaagttaatttaaattaaaatattcacagtgacatttaattccagtggggctgttctgtctgctgaagg

SEQ ID NO: 401461 - DNA, 568 bp, Homo sapiens
caaatcaaaagaggtgcctttaccaaatccaaggaactctcaaagcaaggatactgttcaaggtatgattttgtttttttaaacagaacttaatacctcatttaggtcatgtgtattaaattttggtctaataaatgaaaattatacctatgctttgatttatagaaagtggataaatcattttaaaattctcttatattttaaatatacctggtgcttcatgttaaaaggcatcctatggtaaactgttttgtaaagcaggaatccttttttaaaatgaaccagtatatgtaaaatttttcagaaattctgtcctaatttcaataaatgatatagccccaatatagttacagacttataggggtacagataataatagtaacagtctcattgaattctttttaaaataatgcattagaggtaattttaaggcattgatattttttgagggagattgacaaactagagtacatctggaggaagattattaggtttgtgagagatctggaaatcaagtcatatgaagagtagttggaggaagtggaaatacttatcctggagaaggatg

SEQ ID NO: 401462 - DNA, 473 bp, Homo sapiens
caaatcaaaagaggtgcctttaccaaatccaaggaactctcaaagcaaggatactgttcaagatataaccacatcgtgggatgcactttctcaaaccaaggctgctctgagacacattgaaaataaattagaagtagcccctacaagtacagctgtgtgtgattctgtcatggataccaagaagtcttctacaagtgctactcgaaaaataagtagaaaagatggtagatacctggatgattcttgggttaatgctccaatctccaaatccactaaatcacgaaaagagaaatctcgtagtcctctcagggccaccaccctggagagtaatgtgaagaaaaataatcgtgtggaatttcgtgaacctttggtttcttatagggaaatccatggtgcaccttccaatttcagttccagccatctggaatcaaagcacgtatactgtgtagatgttaatgaagaaaagactgaga

SEQ ID NO: 401463 - DNA, 179 bp, Homo sapiens
ccacaccccccaacccccatccacacaccccacacctccacacctcctcacaccctacacctccatacaccccacacagctccacacaccccacacctccacacacctcacacctccacacaccacacacagctccacacacccacctccacacacctcacaccccacctcacacaccc

SEQ ID NO: 401464 - DNA, 471 bp, Homo sapiens
ccaagtgtgtcaacttgagtcctctgggaagcaaatgccaaaacgaagttagacatgcaagagacttattgggggtaagtcctgtgtaactggaggggagagagaacaggagtagtccagaaaagccttcagcccataacataagccttacacctatgaaaagagatggggaaggaaaggcggtgtggtaggaggatccatagactgcagtgccactctgagaaagccttggccaacccagtggggattctggggcaaagctgggccaatagaagtctgcattgggcagaaatggccagcccagtacctctactgtgttgtcattggctggagcagcctggagagaacacatcctcatctcaggtgctttgcaaatggccaggcacggcacaatgggaggcagaggtgagaggactacttgagcccaggggtttgagaccagcctgcacaacatagagagacccccatcta

SEQ ID NO: 401465 - DNA, 445 bp, Homo sapiens
tgttaacatgttattcagattagagacaagtcttgctggtctgagagctgtcagtcattctgaggcgactgtgtctttttaggttcgaattcaacatttcacttgaatgtaagctccaggagtgcgggaattttgactaagttcatagctatatcccaacatctggaaaggaacttggcacatagtagatatttcacaaatacctgctaattaaaaacatgaagtatatattgatcctagagcctaactggttactaggatcaagtatggagttcttatccaaggactgtgctatggaaccccgagttaaacagtaatcatggctgggtgcagtggctcacacctgtaatcccagcgctttggcaggccaaagcaggagggttagtacttcaatctgggagtctgagaccggcctgggcaacatagggagatttctgtctctcct

SEQ ID NO: 401466 - DNA, 613 bp, Homo sapiens
atatgagaggagaattagtgtccaggccacacggcaccagcctcgcctttgacaattgaggaaaccaagagggggagtcgctcttccaggcagggtaaccagtcatcctggtttgctggaaactgaggggactcaggctttactgggtatgttcaaagtctggttgccgagcctgtgtgtggcaccaaactattgccttcaattttttgtttgctgaattaataaatgcaaatgaatgaatgaatccttccctctcactgcccttctcagtcctccttgggcaccttggctcatgtgccttggtctgagtctagactgtgccagcagcatcctgtgggaggccagatggctggttccgctgctgagttccaagaaaccccttggcccctgcttggttcagcctcagccttcaggaaccccccagggtccacccaacaggcttgtaccgtgtgcctagggaggaggctgggttcccacctggtgagccactcagccccgtagtattagcggtttggcttcagacttgtcactttgcttcttggagctcagtttcctcacctataaaatcacagtactgggggctgggcgcggtggctgacacctgtaatcccag

SEQ ID NO: 401467 - DNA, 431 bp, Homo sapiens
gcggccgcctactactactaaattcgcggccgcgtcgacccgctgggaaggaagcagggaagcaggcattgttgagtgtcgattgtgttgtgattttcctccactttggtctcgaggtctctctggagggtggctgtgaactctggccctgccgtgacgaggctccagggagctgttgtgggcgtttacagcctgcctttcatgagacatttcatcctggcgcatagcctaatgcctgcgtgtccgccccgtgagcagctgtccctcccataggagtgtgtacctcttgcagacgccctgcggctcccgtctgacccacgtctagtttctccccaccaaagtctcccctcgctaggagagccctgaccaggaggagagtcgggcccaggcatgtcggtcagggaagcagagaggaggccccgcggcagaac

SEQ ID NO: 401468 - DNA, 1335 bp, Homo sapiens
agcgctcgccggctcctcgcgcccctacccgctgcgctctgcccagagcagaagcccggccggccggcccacgggcgggaggacgcgcctccgctcgggcggaggcggcgcggtggctgatcagagcgcgtagggcttcgccggggccgggagctgggcgcggtcctgctcagcccagctcaccgcgcgccggccctcggcgccctggttctgcggatcaggagaaaataatgaatgtcaaaggaaaagtaattctgtcaatgctggttgtctcaactgtgatcattgtgttttgggaatttatcaacagcacagaaggctctttcttgtggatatatcactcaaaaaacccagaagttgatgacagcagtgctcagaagggctggtggtttctgagctggtttaacaatgggatccacaattatcaacaaggggaagaagacatagacaaagaaaaaggaagagaggagaccaaaggaaggaaaatgacacaacagagcttcggctatgggactggtttaatccaaacttgaaggaatccgaataactaaactggactctggttttctgactcagtccttctagaagacctggactgagagatcatgcggttaaggagtgtgtaacaggcggaccacctgttgggactgcgagattctcaaggggaaggactgggtctcatttctcccatctcagcgcttagcaggatgacctggtatagagcagggaactgggaaatgtgggtcaggggatcagacactccagttgggtcttttatataaattaaatggcaaaaggctccatacccttctccttctttcctaccctccactttatctgcaaaatgggaatgatgataacacccacttcatagaatggtcatgaagatcaaatgagagaataaaagtcaagcacttagcctctggtgcacaataagtattaaataagtatacctattcctccttttccttttttaaaaataatattaccaaatgtccagcttatacacatttacaagacttagctagtgggctatgttagagctactaaaagatctttgacaagctaaaactaagatgcaatgaatgaggtgtaacgaacaagagagttttaagttcagaaatggttacagaagtataagacagctgtgtgggtgttttttggtttttggtttctggtttacaatctcgtcattcaacaaagatgggagttttatagaactaaaagcaccatgtaagctactaaaaacaacaacaaaaaaggctcatcatttctcagtctgaattgacaaaaatgccaatgcaaataaaaatgattactttttattttatattg

SEQ ID NO: 401469 - DNA, 409 bp, Homo sapiens
accatatatatatggtaaattagaataatctacactgtcttagagtctttaaagtatttcacgatctcacatatacctaaaatctaaaaaagtcaaacttatagatgcagagagtagaatggtagttaccaagggctgagggaggaggaagtgggggaaagacaagcttcgatcaaaggataaaaatttcagttagacaggagaaataagttcaagagatctattgtacaatatggtgactatagttaataatcatgtattatatacttgaaaattgctgagagagatcttaaatgttctcacaacaaaaaataagtatgagaggtgatgcatgttaattagcttcatttaagcatttcacaatgtgtacacatatcaaaacatcatattatgaaactaaatatgtaca

SEQ ID NO: 401470 - DNA, 552 bp, Homo sapiens
agtgacgcattttctcctctgcagtgttgttatattctaaactgtcagcagacattaattcggtcgctggtgaagtcccaccgcctagagatgaactctgcctccgatggatgttttccacttcagtgccactcgtctcgcaattactgggtcattaatatcattgcatgcaattagtgacagtagaaagagctagagggttgtgggatgtgcaccctccccaccatgaactttttactctgaccctttcccagctagaccttttcgtatcttggcaaggatattttaatgattgagactgtcagaatcttcagagcaggcactggattatgtgctggaaataattcactcaaacacctgcttctccatggttcagaatattttcattagatattatcactatcccttccctgggaagtttcatttttaaaaatctgatgcttaagtacagctaatatagacaatagggaattatgttttatctttagaactcttacattattcttttctttaaaaatgtgagctgagtcattgctattgcagtggtcatct

SEQ ID NO: 401471 - DNA, 416 bp, Homo sapiens
  misc_feature (199)..(199): n is a, c, g, or t
  misc_feature (397)..(399): n is a, c, g, or t
  misc_feature (401)..(404): n is a, c, g, or t
  misc_feature (406)..(408): n is a, c, g, or t
  misc_feature (413)..(413): n is a, c, g, or t
  misc_feature (415)..(416): n is a, c, g, or t
gttactgggaaaacctgctgaagatctgtgctttctgccacctctccttgctaactcctacacaccttgtaagactcgggccaagtgcctcctctgcagggaggtccccattgcccctccccacaaggcgcccaccaccgtgcccagctaattttctgtatttttagtacagacggggtttcaccgtgttagccagganggtctcaatctcctgacctcatgatccgcccgcctcggcctcccaaagtgctgagattacaggcatgagccaccgcgcccggccctcagcctcctctttttgaatcctttctccctgctccctccaagctgggctccttctcctgccagcagggcagaacagccatctgtcactctaatagaacctcactcccactcnnntnnnncnnnaacanann

SEQ ID NO: 401472 - DNA, 384 bp, Homo sapiens
acaatcaagaaagcttggatattaattgggtattagacggtactaaggaattattattaattgtattaggtatgataatggtggtgaggttatatatatttttaatgtctttagaggcatatgtcagagatgttgcaggttcggttccactccaccacaataaaacaaatatcacaataaagcgagtcacatgaaatttttgtttcccaatgcatataaaagttacgtttatactacactgttgtctattgtgtgcaatagcattatgtctaaaaaatgcacataccttaattttaaaattctgtattgctaaaaaatgctaacaatcaccagagctttcaccaagttgtaattttttgctagtggaaggtcttgcctcaactc

SEQ ID NO: 401473 - DNA, 179 bp, Homo sapiens
ccttggacaggctccaccataagaagtgggttgcatttaaaagtgtatttattaaaagtggttgaagctgagtgcttttctgtattgtaacactgttgcaaatggggagtattcattcctaatgtggctgccgaaagctttttaccctaccatgtagctgaaaatttagcaaaaaaaat

SEQ ID NO: 401474 - DNA, 343 bp, Homo sapiens
gggaagaagggcgtgtagatcttacttgaaatgcagaggaagccccgagagggttcgagcacagggtgacaccacctgacggccacgtcgaatattactctggctgctgtgtgcagctgggggcggctgggaggctggcgctggcctccggggtagacagtgaaaccaggggcaaggctggtgatggtgacgatgggtaccggtggaaatcggacgtgagctgcaggtggagccggcatcccccggggaggactggcagagggtggagctctgtcctgccaggagtgccgtgaaaatgcacagacgctcacacctagatcctgcagataccacgtgtccccag

SEQ ID NO: 401475 - DNA, 535 bp, Homo sapiens
gtttctgtgtgtattcgaagggggcttcctggtttgtgaaggacagtaagtattcagatccatacgtagatcagtagtatgttacagtagcatagaagccatttggaacatttagattgtagtgtgaacttctgaaccactgagtgttgtggatgaacagaatgagacagcaaaagtggtatttgttaaacacttttgacttctggttgaagatggagaattaaatctatgtattcacctaagctcccttatgtcaccatgctaaaattacagtgaaggggttttaaggtgttgttgtagttgttaagtttgtaagtctaaaaaaatgaatagaatgggataaaaggcaagagtaacccattttttgaaactggaaagtcgagggtcaaatggtaaagaacttagcagacccagtacaactgaatcccaagccagcaatgcggaaacctaagacccatccagagccccaggctttgtggcttcaggtacttctggaagtgagggagagaaatggttgaaaatctgtttaagaagc

SEQ ID NO: 401476 - DNA, 394 bp, Homo sapiens
tgcccactgaaaaataactgctctcccccgcctgcaggtaaccaccattctgctttctgtctccatgaatttcactattctaggtacctcctacaggtggaatcacacaatatttgtccttttgtatctggtttatttcacttaggaaatgttaaggtacatccatgttgtagcatgtatcagaattgcattattttaaagactgaatagttttccattgtatgtatataacacattttgttcaaccaatcatctgacaatggacattagggttgtttctaccttttggctgttgtgaataatattgttatgagcacaggtgtacaaacatctatttgaggctaggtgcagtggctcacacctgtaatcctagcactctgagaggctgaggggg

SEQ ID NO: 401477 - DNA, 546 bp, Homo sapiens
atgtgcctgttgttcccatttaaacaacaacaaaaaaaataaattgtgaatctttctctacatctagtatcttttctaccaggtctctggtagaatgtcaattccctgaaaacacagattgtgcttttgctttgttccagacaatatgtgtctttttagggtagaagtactaaaaaatgaaaaataaaatgctaagctaattgatggttatgatatattgtttcaatccccctaaggccaggctgtgaactatttcaaccagacatagtctccacaaagttgtagatctgagtgactctgccaagcatgattctatttgcaataagtcttttacagttatctactattttctcaatcactcccttgcatttaaggtttagcaactagttcactgtatacctctccacgactactccatgcactagctttagtaactccaatattccttatcctctttttctcctgtgttcacctaacaaactgaaactctgttaaaacccaactttctatctgctccctacttgcacctcagcagctggaagtagt

SEQ ID NO: 401478 - DNA, 279 bp, Homo sapiens
ggacctccctgatcccttacaatttctactcatggcttcattatctctccaccgttgcaagcactgaatgagattatggacgtaagagttctggtgccaggtaagttatcagtaaacaaatgttagttccttcaatttttttgttctcatactcccctctccttctgtattcttacctactcaggatccttcaatagaaattaaactttgcagacaaactccccagggccttctagatgacatattctttctgtgaaaaagtgaatttattgacttttc

SEQ ID NO: 401479 - DNA, 420 bp, Homo sapiens
actttcataatattttgcatatgttttctctttactttgtattctctccttcctgatctctatcctcttctgacttttttgatcccttactcttctggttctcctgtctttatcgttttatttcaggttattcttatctgccccttaaattacctatctgcaagatctcagctcactgcaacctccacctcctggggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcatgaccacttatccttccagtttcaagtagaatatattcataacctcaataaagttctccctgctccc

SEQ ID NO: 401480 - DNA, 334 bp, Homo sapiens
tttctttatagtttgcttttttttttaagaggagggaaatggggaaaaaggaaagacaagctgaataagctcaaagacaaaaaaacatgaactttcccataatatgtcacatgaaacagaatgtagagccacagaaaaaagatactgcctctaaaaaccaaattacatttaaattttaccaagataggtgataaatgtttaccctcagatacacgtggcttttgggagcagaaaatgtctctttaatctgaattatgtacatgattatgatcctctattacatgttaaatctgaatacagggtagtttattaatgaatagaaagagactgtcat

SEQ ID NO: 401481 - DNA, 666 bp, Homo sapiens
aatcaggagatgagaattctggctgcactgctgatgctaagtgattaactctagatttaactcttcattggtttaaaatgtgatattttggccaaagatgggggaacttggaaagaaaaaactgcaaaaatacatacatcatatcttatttgctactcgcatgctataatcagatataatcccaaatttgttctcttttgttggaaataaacaggatgtgatttgtttcggagattcactaaggagaaatgctacaggcaacatgccctcttacaaaccagcctgcccctgcatctagcttatctgtataatacagcacctatgagattacactctgggtttgaaccctagctttgctgcttactctctgctctcaagcaacttaacttctctaggcatcaatattcttctctgaaaaacagaaaaataggatgggcagtggtggatcgcttgagtccaggagttcaagaccagcctgggcaacataatgagaccccgtctctacaaaacataaaatgttagccgggcatggtggcatgcacctgtagtcccagctacttgggagtctgaggtggaaggattgcttgagcctgggagttccaggttgcagtgacctatgatcacaccactacacgcatcttgggcgacagagtgagaccctgtctc

SEQ ID NO: 401482 - DNA, 551 bp, Homo sapiens
acttcactgcaattctgtttccctcatttgaaaaatagaaatagaaaagcctgctgtatatttaggtccacatctgttggggaggtcaaagaagaaagaatatgaaaagttgtttgtaaatataaagaaccatgtaaatataagacattgttttattaatgctccagatcaattaactttcagtgaatgataaaatgtgacatcttttcaacagagacagttttacttaagaaaaactaggcaatggcttctgtccttacaaatgaaaaacttcataataaatgggggctctcaagaccacctggccaaaactgaactaaatactcacttcattcaaccaagaatgaggaactgaaatacatgattattatatatgcatatgcttctgtttcatctacttgggcatgcttgtgatgagatatgaaaaattagccatctttagaaggaaagaaatattgtatttgggggtatttcttctgtacagacaattggcctggttattgtctaaaggtatttaaaattaataaaatgcaattttatgctacataaaa

SEQ ID NO: 401483 - DNA, 3619 bp, Homo sapiens
ttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaagtcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataa

SEQ ID NO: 401484 - DNA, 1042 bp, Homo sapiens
ttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggtaattgtttcaaaaggattgcatgggccaggatgtccagataagcactgtgtctcttttgcctttgtaactgttattactctttttactgctatttaatatgtaatgtatattatatgatctataatatatatgtaatatacattaaatgggaacatgtgcaaatcttaaaa

SEQ ID NO: 401485 - DNA, 399 bp, Homo sapiens
cccgttccccccaatttatcccttttcccctcccccccccaacatccttcagttctgcaaatttctgcaagtatggaaccaaaggagaagccggttcagttgctttttcaggctttgaaagaaagagaattattaactcagtaaaattcccacttgatttgacatacaaaatcaaaattcaatgcaatctgaagtgttttctaatatattcaatactcactggactgtcatctatgaagatgataagcaaatgattcacagtatcctagtggaaaataataaacataagtcaaaataattccactactgtattctccccagaattctcataacttgtatcatattatgtaagtttctagaaaaatgaaaaaataaatggagcagtagcaaaaaatctgc

SEQ ID NO: 401486 - DNA, 407 bp, Homo sapiens
tccctcctattctctttccgtccccccctttaaccattaaaaaaaaaagaaccctccaggttctgcaaatttctgcaagtatggaaccaaaggagaagccggttcagttgctttttcaggctttgaaagaaagagaattattaactcagtaaaattcccacttgatttgacatacaaaatcaaaattcaatgcaatctgaagtgttttctaatatattcaatactcactggactgtcatctatgaagatgataagcaaatgattcacagtatcctagtggaaaataataaacataagtcaaaataattccactactgtattctccccagaattctcataacttgtatcatattatgtaagtttctagaaaaatgaaaaaataaatggagcagtagcaaaaaatctgc

SEQ ID NO: 401487 - DNA, 516 bp, Homo sapiens
  misc_feature (43)..(43): n is a, c, g, or t
  misc_feature (45)..(46): n is a, c, g, or t
atatataaaaaaaaaaaaaaaaaaaaaaaaaaaaaaaaaaaantnnttaaaataaaaataaaattcggttctgcaaatttctgcaagtatggaaccaaaggagaagccggttcagttgctttttcaggctttgaaagaaagagaattattaactcagtaaaattcccacttgatttgacatacaaaatcaaaattcaatgcaatctgaagtgttttctaatatattcaatactcactggactgtcatctatgaagatgataagcaaatgattcacagtatcctagtggaaaataataaacataagtcaaaataattccactactgtattctccccagaattctcataacttgtatcatattatgtaagtttctagaaaaatgaaaaaataaatggagcagtagcaaaaaatctgcacatatgtattacagcaggagtttttttacatctacaaaacaggttcttaacctttgtgaaaatgggcaaataaaagctattctgattttggcatttaaaa

SEQ ID NO: 401488 - DNA, 502 bp, Homo sapiens
tcacccaacgatacacgagttcatacaaatacacaacaaacacaaaagccttagttctgcaaatttctgcaagtatggaaccaaaggagaagccggttcagttgctttttcaggctttgaaagaaagagaattattaactcagtaaaattcccacttgatttgacatacaaaatcaaaattcaatgcaatctgaagtgttttctaatatattcaatactcactggactgtcatctatgaagatgataagcaaatgattcacagtatcctagtggaaaataataaacataagtcaaaataattccactactgtattctccccagaattctcataacttgtatcatattatgtaagtttctagaaaaatgaaaaaataaatggagcagtagcaaaaaatctgcacatatgtattacagcaggagtttttttacatctacaaaacaggttcttaacctttgtgaaaatgggcaaataaaagctattctgattttggcatttaaaa

SEQ ID NO: 401489 - DNA, 1704 bp, Homo sapiens
ggatcgatgttcgtgaggatcacgatgttcgtgaggatcatcgatgttcgtgaggatcacgatgttcgtgaggatcacgatgttcgtactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaagtcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataa

SEQ ID NO: 401490 - DNA, 4139 bp, Homo sapiens
ttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaagtcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataagctctttggtctttgatagttatttcttctctcattcaaacacctgccaactaaagacaatatgactgaaggaaaactctgacagattttcactggtatcatttctcttgatcataagccacttaccatctgataaccctccatagcccctcacacccctaaaatgagaagaaaaatgcatccaatttttaagtaggagagaaaagtgagtggtattttaaggaagactactaaatttggtggctttgatatacagaatctgatataaaaatggttttgaggccagtactgattcctacaaataaacacttccaagttaatgttgaggattttaatttgcctgtactggctgtgtgcctaagatcttcctcaagtacactaataacacaatgagttggtttcgttatacctcaatcagtcagacacgttaaaccacgttagctgtctttgtttgggctatgtattagtccgttctcatgctgctaataaagacatacccgagactgggtgatttataaag

SEQ ID NO: 401491 - DNA, 2435 bp, Homo sapiens
ttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggtaagacccgagcccgcgcccgggatagtagtcccggactgagagaggagccgggctggaaaagcagcggatggcagagtgtggcaagcctaggtccagggcgcggagagatgtggggataaagtgagactccggccagtgtgccagctggatgcatagaagtcccttggacgattcgtcttaaacggacgttattgcgcccccactatgagatgggagtatttagaggagcaggacccagtcctgcctgcgaggggcttaaggtggggtgcgtagaagcactgacagttatccagagctagggactgaatcggatccctcacgcagctctcatttactgctagatctttcaaagaatgctttatctcaatctagatctttcgaaaaatgctttatctcaatcttattgaaagggaaaccgcgtcgaagaagctgaataaattaacaggcaccatccccgcaaaaagggagacgtgataagaatggacaccagatctctttgaccccggagcttgagagtaattaagctcacagctttggggtagattctctgttcaattaccttctatgtgaccttgagcaagttatttactctttcttgcctcagttctatcctgtataaaaataaggattataattgtacatagtgcacatagtgtggtctctatattattaccagacacatagtgtggtgtctatatatgttgttattaccagacactataatatagggttaagaaaaggaaagaaagaaagaaagagaaagaaagaaagaaacttcagagagagccaaaatgtggaaagacttgggtttcaaaggatttcaataaagtaggtttggcggcagagatttaggaagagtccaacttaagagataatgggctcttaaaacatgtgcaaaagtttagttcaaagtcccaaatgttaggttaaaggtaatgccttttctattgcactaaattctagaaagggagcagaggtggttgcacagtaataaataagtacaaccaagatgtatatatggtggttaaaaaaaaaataaaaccaccacccaaatttaaccctgtgtaaaagccttgagtaaagggattcagcaagactgtggagaaacttgggagaagaaaaaagagctttggaagaggaagaactgagaaatctccagagaaacgtccagagaaatctgtgaagtccacaagtgtggaagggaaagggaagtgtgattaggctgggatacagaaggctaacagtacactttatatgagaagagcttagaggtcaggagagcacaatgctgaggggtttgtttggttttattttcccctctggaaacttggagaaaggaggacaggaaaagatgataagagggcaccattgtttggttttaaaggtccctccccaaccccccacaacaagaaagctcattttaatgagatgagagaaggggagaaagctccctccgttctgatgcttttgagcttatcagggacaccctgcagcagaaattccagctgatccttcagccttcagagttgatgaggtggggctcacacacatctggatttgaagaagaatcgtgggtttcaagaactctgtggtctcttaagcattggtattccacagctacacttccctgatactttgcactcagtaatgacaaaataaatatttgtagaattgagttgttgctaccctgtgtctccacttcctcccagaagggtagaataaacttacatgtgtttgttttattttgcatataaaccacgactttgtaaactttactttttgtgacactcttttctccacaattgtgtgaaccctttttagtggaaaaataagaatgaagaattcctagttttccctaataatatttccctcttgtaagtctagttgagctcctggtgttaatcatggtatcaaatgtttatgacaggacatctaggtgaggcctgagtaaactgctgtaagttacagcctatct

SEQ ID NO: 401492 - DNA, 2135 bp, Homo sapiens
ttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggtaagacccgagcccgcgcccgggatagtagtcccggactgagagaggagccgggctggaaaagcagcggatggcagagtgtggcaagcctaggtccagggcgcggagagatgtggggataaagtgagactccggccagtgtgccagctggatgcatagaagtcccttggacgattcgtcttaaacggacgttattgcgcccccactatgagatgggagtatttagaggagcaggacccagtcctgcctgcgaggggcttaaggtggggtgcgtagaagcactgacagttatccagagctagggactgaatcggatccctcacgcagctctcatttactgctagatctttcaaagaatgctttatctcaatctagatctttcgaaaaatgctttatctcaatcttattgaaagggaaaccgcgtcgaagaagctgaataaattaacaggcaccatccccgcaaaaagggagacgtgataagaatggacaccagatctctttgaccccggagcttgagagtaattaagctcacagctttggggtagattctctgttcaattaccttctatgtgaccttgagcaagttatttactctttcttgcctcagttctatcctgtataaaaataaggattataattgtacatagtgcacatagtgtggtctctatattattaccagacacatagtgtggtgtctatatatgttgttattaccagacactataatatagggttaagaaaaggaaagaaagaaagaaagagaaagaaagaaagaaacttcagagagagccaaaatgtggaaagacttgggtttcaaaggatttcaataaagtaggtttggcggcagagatttaggaagagtccaacttaagagataatgggctcttaaaacatgtgcaaaagtttagttcaaagtcccaaatgttaggttaaaggtaatgccttttctattgcactaaattctagaaagggagcagaggtggttgcacagtaataaataagtacaaccaagatgtatatatggtggttaaaaaaaaaataaaaccaccacccaaatttaaccctgtgtaaaagccttgagtaaagggattcagcaagactgtggagaaacttgggagaagaaaaaagagctttggaagaggaagaactgagaaatctccagagaaacgtccagagaaatctgtgaagtccacaagtgtggaagggaaagggaagtgtgattaggctgggatacagaaggctaacagtacactttatatgagaagagcttagaggtcaggagagcacaatgctgaggggtttgtttggttttattttcccctctggaaacttggagaaaggaggacaggaaaagatgataagagggcaccattgtttggttttaaaggtccctccccaaccccccacaacaagaaagctcattttaatgagatgagagaaggggagaaagctccctccgttctgatgcttttgagcttatcagggacaccctgcagcagaaattccagctgatccttcagccttcagagttgatgaggtggggctcacacacatctggatttgaagaagaatcgtgggtttcaagaactctgtggtctcttaagcattggtattccacagctacacttccctgatactttgcactcagtaatgacaaaataaatatttgtagaattga

SEQ ID NO: 401493 - DNA, 1767 bp, Homo sapiens
ttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcgatttaaaggaatgctgtccaatctgtattaaccaggatgattcctggaaggagcagcctactgcacagacatacctgaacacctggttctagtcccactgtgacctggggcaagttctcaacccctctgggcacagggagaaaacctttcctgtttatctcatggactgcagtgaaagttgaatggaaataaatgcttcctaaattgccaagggcttctgaaacacttttgttaataattccacagtccagtgaattaatcctttaaaagcaatcttattttacctgga

SEQ ID NO: 401494 - DNA, 407 bp, Homo sapiens
  misc_feature (16)..(16): n is a, c, g, or t
  misc_feature (20)..(22): n is a, c, g, or t
  misc_feature (52)..(53): n is a, c, g, or t
attaaagttattaatnaaannnaattaagtatatataaattattatatattnntactaagttctgcaaatttctgcaagtatggaaccaaaggagaagccggttcagttgctttttcaggctttgaaagaaagagaattattaactcagtaaaattcccacttgatttgacatacaaaatcaaaattcaatgcaatctgaagtgttttctaatatattcaatactcactggactgtcatctatgaagatgataagcaaatgattcacagtatcctagtggaaaataataaacataagtcaaaataattccactactgtattctccccagaattctcataacttgtatcatattatgtaagtttctagaaaaatgaaaaaataaatggagcagtagcaaaaaatctgc

SEQ ID NO: 401495 - DNA, 3469 bp, Homo sapiens
ttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaagtcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataa

SEQ ID NO: 401496 - DNA, 2197 bp, Homo sapiens
ttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggttctgcaaatttctgcaagtatggaaccaaaggagaagccggttcagttgctttttcaggctttgaaagaaagagaattattaactcagtaaaattcccacttgatttgacatacaaaatcaaaattcaatgcaatctgaagtgttttctaatatattcaatactcactggactgtcatctatgaagatgataagcaaatgattcacagtatcctagtggaaaataataaacataagtcaaaataattccactactgtattctccccagaattctcataacttgtatcatattatgtaagtttctagaaaaatgaaaaaataaatggagcagtagcaaaaaatctgcacatatgtattacagcaggagtttttttacatctacaaaacaggttcttaacctttgtgaaaatgggcaaataaaagctattctgattttggcatttaaaa

SEQ ID NO: 401497 - DNA, 2096 bp, Homo sapiens
ttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggttctgcaaatttctgcaagtatggaaccaaaggagaagccggttcagttgctttttcaggctttgaaagaaagagaattattaactcagtaaaattcccacttgatttgacatacaaaatcaaaattcaatgcaatctgaagtgttttctaatatattcaatactcactggactgtcatctatgaagatgataagcaaatgattcacagtatcctagtggaaaataataaacataagtcaaaataattccactactgtattctccccagaattctcataacttgtatcatattatgtaagtttctagaaaaatgaaaaaataaatggagcagtagcaaaaaatctgc

SEQ ID NO: 401498 - DNA, 747 bp, Homo sapiens
gcgcatctagagtagtgcttcacccagcaggccctcagttaacaggcatatggattcgactggtgtttgtgtttttctgtaagaaaggttatgccatgtctcaaaaaatgaatggctaatgtttctaggtagatacaattacaaagacgtaccaaataaaataatgagacaaaaagaaataggtagattgggattggctgtgtagaggttttaaggtaaaagtgggcaagttaaaaaggtttcgtatcagagaagttagttgcaatttattgaatgtaggagtactcacacagtttatttgaatatgaaatagatccagatttcttatgtatggtctccggttttccataccgattgatagttcagggctgctttgacataaatactgtgcttctactgccacctacagatgattagtgggtcttggagctcttcacctttaccccttctaaagtctctttgaaattgaaataattttttttaaaagctattaattggtagaatattataaaatattttaatgttactttatgaatatttctatattatattacataatactatataatatgtagctttatataatagatatgaatgtattcctctaaaacaaggtggccaatcttctggcttcccttggccacattgggagaactgtcttgggccacacataaaatacactaacactaatgatagctgatgatcaaaaaaaaaatcatggaaaaaactcataatattttaagaaag

SEQ ID NO: 401499 - DNA, 183 bp, Homo sapiens
acatgagggcctgaagctttggcagcattgcaatgggtgtgatgcagaaccagaggctttcaggtggcactggggagctgggatggaggttaagggagaaaggaagacccaacaaaaggaacgagtaggagaaactttgcctattccactgttttgtttaggccaaccttaatccctgggatt

SEQ ID NO: 401500 - DNA, 290 bp, Homo sapiens
tcagcacacagccaggaagtgacgagggtatttcaagaggctccttatcgattagcccaaggtgtctggcccagtcctcaccctcctcagggccatgggctgggagccctctcatctctcctttgctagtggaggctggggagactgcgaatggctatcaggacttgagaaggtgtggctgggagattggctacgaatgcatggagattacaaaacagggagatgggtctccatgtgtggtctctgtgattcatctgagggtccgaagttcgagctcacctcctggggag

SEQ ID NO: 401501 - DNA, 431 bp, Homo sapiens
tgaaattagaaggtatcttttaaactgaaaagtaacttgaagattttttggagctcccttaaatgatagctatttacagcaaaattttatgttgatcttttaagtctttcaatatgtattagcatacaaaaggcacaaaataataataatgttacaataatttcataaatattttgtgattatggagaaactgaattttggtacaatctgtcctgcatgtgtttgctttcatttatttagtatacctctgcttcacctttctctaaaatctccctccaaaatgctgcttccttggaaagtgttacaagtaaaccatgttcttacaattgcatttttggagaagcatgtgggtgttgttggattcacttgagtagaattttaattagatccagtgcattcacttttattaaaagaaagtatactgattcctt

SEQ ID NO: 401502 - DNA, 472 bp, Homo sapiens
gtgcaaataactggttatccctcaggtcctgctaccccatctttcctgatccccgatccctccaaatacgaagcacctcgcatttgggtcagcagctgtttcccctgcctggtgacaaggccggtgtgcagagggcagaggagggagcttcttccgccacacggtggcgcgcgcgagcctcccaaagaccgggcggccacagctcctcaccttctccccattccagccccacccgcgcccgggcgcagaaagagccgcgcccccagccctcccgggcaggacagccgggagcgcacctcgagggcccgggcagcggtcgagtggcagctgcgtccagcccatgcgggagctgctgcgggttacgggtggccccagctccaggctcctcctccagccggtcccccaccctccaccccttctcgactccgctctgcaaatcgaaggcttcccggagcagcctaggagcggccgc

SEQ ID NO: 401503 - DNA, 230 bp, Homo sapiens
ggctctatccccagagacttggattcaataggattagggtgagagagatcagcaatggaaatccttgatatagtggtttgtcctgggtggggttttaagaatttatacatgataaatcatgtaggaattatttttaaagtagaaaaaaaagcttttatcatgcaaatatagggctgaccaaagtgctatgtacttagctgaggcataggagcacctacctaacctagaaa

SEQ ID NO: 401504 - DNA, 555 bp, Homo sapiens
aaattaaaaaaggtaaaaggaggtttcagcttcacgtgttcggatagattaactctttgtgctcaaaaaaaagattgttgaagctcccttaaggataactaatgaggagcacccaggcatctgaaagaacgagaagtctgtttttcgttcttgcctaattgccgttaagcaaagatactcttccctaaaagggaaaaatggctccttacgtgttattcctctttgttagtaatgatcactgtgttttgacctcttttcaggatgttttttaaaccatgttttctggttcttctgtagtcttaagtatgtttgatattgttaggtgatctgcataatgtttaatcatttttttctttatataaaccagttggtataattatacctcttttcctatttaagtttgtatgtgtatatgtgattctatagagtagaaaaatgccatcagtttgaaatgatggcacaatcttagtcacttggtttaaataaatagaaaattctaaagccttaaaattaagataatgctctttggcaaactcaaaataaaagcaaaaaaaa

SEQ ID NO: 401505 - DNA, 323 bp, Homo sapiens
tcaggtgcttcaaatttatgctgcagctttgatatcacagacacacggtctcctgagggtttagacccatcattttggaaggcatggccataggcagtgtgagaggcaggggtcactcatggagtattgtaggaggctcagacggctgcaacggctgctcgtgcatagaccaaatggatggtgtagggagagaccgggagaggagaccatggatcaggctctcacagtggtttagggatgaggggataatggcctgatttaggatgggggagtgacatgggagcaagagaacgatatgaaagttccaacactggtgacgaggg

SEQ ID NO: 401506 - DNA, 158 bp, Homo sapiens
ttttttattatgtaagcaatacatgttcattattttaaaaaatagaaaatatagataaccataaagaaaataataaaaattgcctagcattttatgacccagaaataatattttggggtccattcttcaagatattgaagaacgcatatacagtttta

SEQ ID NO: 401507 - DNA, 651 bp, Homo sapiens
gaacaagggtctagggaaggaagtgaatcccaggcagaggagatgaatgaggcagggcctccccttgaggctaacacggagacaaggccagagaaggaaggaccccagccccaggagaagccagtaggagccctggaggaggaaggagtgaagccccaaaccgctgctgagggccaaggccccttgggggatgccacacctcttctggcagagaccccagccccagagcagcccgccgaatgccagccactgcttcagggggaggggcccagcgccaaccccagtgcccaccctgtgcccacctacgcgcctgcccggcagcctgagccatctgcccccaccgagggtgaagaggcaagtggccctaagcaaaagacgtgccagtgttgtgcggtcatgtgaacccatgcccctccaccccatgtccagctcctctcacagctacctcggcctcttggcacccagaagagggtcccaggcacagacagggaccacaggactggccatggcacctgggagccagctagcctgcacgtccacctaaacctgggcttccagaccccttgcccactgcctgtaaccctggcctccttctgcgatgaagcctttatacttgaaaataaaatgtgaaagcactcaagacggcttgaa

SEQ ID NO: 401508 - DNA, 2096 bp, Homo sapiens
tgaactctgaactttttattggcctcctgctccccaaagggtaccctgcttctgctggcttaatgcctcagaactttggtgtcattggtctcagacaccactttgccatccactatccggcgggtggtggtcttttggatggtttgcatggagttgctgctgtccaaggcatcaccaagattaaagtcctcgccatcttccagcaggcggcggtaggtggcgatctcagcctccagcttgaccttgatgttcagcagggcctcatactcctgggcctggcgctgtccctctgcccgggtctgtgccagctctgactcaaggtgcagcaggatcccgttgagctgctccatctgtagggcgtagcgggcctccacctccctcaggctgttctccaagctggccttcagatttctcatggagtccaggtcgatctccaaggactggactgtacgtctcagctctgtgagcgtcgtctcagcagctccaacctcagcagactgtgtggtgaccactgtggtgctctcctcaatctgctgagaccagtacttgtctagctcctctcggttcttccgagccagctcgtcatattgggcccggatgtctgccatgatcttggcgaggtcctgagatttgggggcatctacctccacggtcaacccagagctggcaatctgggcttgtaggccttttacttcctcttcgtggttcttcttcatgaagagcagctcctccttgagagcctcgatctctgtctccagctgcagtcgtgtgatattggtgtcatcaatgaccttgcggagcccatggatgtcgttctccacagactggcgcatggccagctctgtctcatacttgactctaaagtcatcagcagcaagacgggcattgtcaatctgcagaacgatgcgggcattgtccacagtatttgcgaagatctgagccctcaggtcctcgatgatcttgaagtaatggctccagtctctgacctggggtcccttcttctccaagtgctcccggattttgctctccagcctccggttctcggtctccaggctcctcactctgtccaggtaagaggccaggcggtcgttcaggctttgcatggtctccttctcgttctggatgcctcccattcctgccagacccccggctatcccggtggccaggcccccggaccccatgccgcccctgaagctggtggagcgggacacggagatccgggaaccagagcccccagcgcctgcatagacgctggccgcgctgctgaccggccgggcgccgtagctgggcgcctggacagagcccagggaccggtagttggtggagaaggtggagcgagtggtgaagctcatgctgtccggggagagagaaaggacaggactcaggctttgcgagtgtggtgtgggaagggctgagggccacagaggactgtgccacaggggccacgggccccgagctggaggctaaggtggaggaagtggtgctggaagccatcggagacaggaagggagctggtagcctggagctcccggcctgggtgaaggaggacaggggcatcgtggaggtggtctgggagggggtgggtggcagtgatgcagaggccatgggggagataggcagggtccctgaggtcgtgcagactagctcgcctaggctccaggagagattagaggcagcagcttccatagaaggggaagatgtgccccagggcagccctgagggtgatgggcagggaggctctggaggagaggagggatccttcatttgggtggagagagtgaccctcagtgaagagtgggaggagctgctggtggaggggttggaagggcccgaggtggcagggagggagagaggagatgaaagcccatgtccagctcctctcacagctacctcggcctcttggcacccagaagagggtcccaggcacagacagggaccacaggactggccatggcacctgggagccagctagcctgcacgtccacctaaacctgggcttccagaccccttgcccactgcctgtaaccctggcctccttctgcgatgaagcctttatacttgaaaataaaatgtgaaagcactcaagacggcttgaa

SEQ ID NO: 401509 - DNA, 204 bp, Homo sapiens
gtgggaccacctctgctctgaaggcccccagggtcagtacttaagagctctgatgctaggagcagcaagaacaagggggccgcccttttgcactcatctcccgggcggagagcggagatgagaaggagaacagacaggaaacacggagcctctgcctgcagtctctgccattctgccctggacagaagcatgactaatccagca

SEQ ID NO: 401510 - DNA, 331 bp, Homo sapiens
ccctggacattctggtatgattgggaggcatcctgagtcctcccagattcagaagccactgtgtttccttacagcctgcagaatcatgagccaattaaacctcttttctttatgatcatagagaaaattagtagtgcaaagtggaactattaaatgtcattgtcgtggcaatcagcactcagcttcttttcattcaagtatgtgaaggcttcatgaattttccccctgaaaatggacttgttttcctttaccacattgtcaggctgtggcaaagatagtgataatgtagaagcaggttcagaagggagtagcagacagaggtcggaagagt

SEQ ID NO: 401511 - DNA, 343 bp, Homo sapiens
caggtactataattatcaatgttttataattgaggaaactaaaccacatagaagttgaattacttgtccaaaactacctaattaataaatgatagagctgaaattgaaatccagaaatctgagtctcagactctacattcttgaaagctatgccatactaccttatatttatcacttcaaaaaaaaatcttttagtttcaggagtacatatgcaggtttgttatatataaactcgtgtcatggaggtttgttgtatagattattttgtcacccaagtactaagcctagtagtcattagttatttttcctgatcccttctgtcctcccaccctgcaccctccaa

SEQ ID NO: 401512 - DNA, 685 bp, Homo sapiens
gaggaactagtgactagcgtcctatttgacgcataaggagctggcagggttgaaagtggagcccaggactgcaagcatggccatctaccctcggggccggcaccagcctcggggcagctgaccttccccacctcagaagctctcattcctctgggctttccacaaaccacccttcttgaccacaaaaaggtggccatcctgactggtctctaccttcaggaaaacaaatggggacctgagggcgctcaaccaccccagaccacccagaagtcacaggagcacggaacaggaagcagggagacagcacacagtaagcacatggcaagcacacagtaaacacacggcaagtacatggcaaatacacagcaggtacacagcgagcacacagtaagcacacggtaaacactcagcaagtacatggcaaatgcacagcaggtacacagcgagcacacagtaagcacatggcaagcacacagtaaatacacagcaagcacacagcaagtacacagtgagcacgcggcaaacacacgacatgcacacggttagcacactgcccggctccctccaaagccacttcccccacagagaaaggagaaagcggccctggcctggcagtcactcacagtccctctggacctggagccagcggctatggcggacgaagaggcacctgttcccaggcact

SEQ ID NO: 401513 - DNA, 367 bp, Homo sapiens
gttgactatcactgacctatgacgagagcacgtggatgacacgtaaaatcaagatcaaacggtgatgctaccgccagtcgtcttcaccgcgtggtctccatgagatacaagccaccgaaactacacgcgtcggcctgacctatcactccacagataaagtacacgctcgaagtgcaacagcaagtacacagtgagcacgcggcaaacacacgacatgcacacggttagcacactgcccggctccctccaaagccacttcccccacagagaaaggagaaagcggccctggcctggcagtcactcacagtccctctggacctggagccagcggctatggcggacgaagaggcacctgttcccaggcact

SEQ ID NO: 401514 - DNA, 166 bp, Homo sapiens
agatgtgagaggtgaaataacttgcctgaggaaacacagctcaaactggaactgactcctaagtctatgattttaacctcttgtgaagatggttctatgaaaagtccgtaacaacatacaacccattaatttagtaccagatgtaaaatgtgatttaactgcctta

SEQ ID NO: 401515 - DNA, 114 bp, Homo sapiens
aaaattatccaaacttctccagaatcatctaacaaatgtaaacacttttaacatgaaaaagtttgcttacagaactaaaatattctccaaagactaaagtttgaaacccactta

SEQ ID NO: 401516 - DNA, 377 bp, Homo sapiens
ttgcactagcattatgtacaaacctcttcttcaccatacccttgtccaatttcttgtcatgttctcctgcccaaggattctccgtggtgatgaattttgaggtagccaaaagcaacagtggctttgcaagggcttgctcctcccacaataaaaactctataaacccttgtcctccaggtggtggatgtgcatgcaccctggcggcatctgctgctccctttgcataagacgggagggtatacgtttcctgagctgatctgactctgagagccagggagcttcggctggggcatctccctgagaagcagcatggagcagcctaacagtaaaggctatagcctgggaaggacccctcagggcccagagtgcagcagtgc

SEQ ID NO: 401517 - DNA, 664 bp, Homo sapiens
ggtatggggggaggtcgagtgggcaaacacaggggaggcagggcatggtccagcgctcacaggtgctagggaggctcatgcaccacactgggaaaaggtagggaagtctagcagggatgggctgggggtgccagggctgctactggctgaaagtcattttagggaaatttattgggtgagcaagctctgggcctccctccccatctcctgctactgagaagtcaggccttgctctataaaatgggggagaggggtggacaagtgcagtcgcatgcatgggttgggggcatctgcagtgtttcccctcactcagcccttaactctgggtgggctcatttctcacatgcagtgtccagggcaggccccaccccatctcctggtgggactcggggtactgtatgcctgtccagattaggaggagaccactccctccttcttgctcttctgttacccatgggtcatgggctggggcttgtggcaggcaggcaatctaggcatccatgtgtctcggggctaagacagaggctggcaagggctgactgacgctgggttcttctcctaggagcttcggctggggcatctccctgagaagcagcatggagcagcctaacagtaaaggctatagcctgggaaggacccctcagggcccagagtgcagcagtgc

SEQ ID NO: 401518 - DNA, 164 bp, Homo sapiens
caatggtctgggcaatgattttttggatatgattccaaaagcccgggcaacaaaagcaaaaatagacaaatgggattacaacaaactaactgcacagcaaaagtaaatcagcaaagcaaagagataacctacagaatatgaggaactattttacatctcataag

SEQ ID NO: 401519 - DNA, 221 bp, Homo sapiens
agcattcctaacaaggtttatgcaagcagtattggccctataatggagtcataggttgtcatgatttcataggttccctgtctctcagtgaaactcagaatcccctttgtcccaggtcctaagtctatctatattttagtgtttgagctatcggaagaatgatccaatagaaaactggtagtttccattcatagttctgagatttaaaatagcaaaaaaag

SEQ ID NO: 401520 - DNA, 452 bp, Homo sapiens
aaaatggtttttacataggttcttacggtacgcttggagtacacttacaggccactgctgcagtctacattttattgtgctgaatctgcattctatcagatacccatggaaagacctcagtatatgctttgcactctgctttgctccccttttccaatttcctattgcaaatcattttgatgtaatacagaaaaaacagcatttaaatatctacatgaagagttgacccactaatgtcagccgacctctactttgtcagctcatagttaaatcttttatcatttcaaaaataaagtgcattttctttttctttttcttctttttttagtgatggagtctaactttgtcacccaggttggagtgcagtgagctgagatcgtgccattgtgatatgaatatgccttatatgctgatatgaatatgccttaaaataaagtgttccccacccctga

SEQ ID NO: 401521 - DNA, 843 bp, Homo sapiens
tggaaagatacacacaaaattcaggatggtaaaagaagaaaggagattcctcttgcaaaagaagccaagtataaacatggaagaacaactgcctaagcaagtagaaaagtgttccataatagtgcgcaatgaatgaagagttctggattaatctctggaactcaacctgcaccctgatctttattttgaatgggatctagaacgggatcttgaagtagctctttttggcggaggggacacagaatgaccctttgagggtggagcaggtaggggtgaattggaacgagactggctccttgatctgtattttgacttcatatcaccttttccattttctttggaagatcgggacagagacctgcttggagatttctcatactcatccttagatctgctttgagaacaagaacaggagcccagatcagatttgggcatagatttgctccttgagctagatttcctgccttttgaacgagaacgtgatcgacctttgctccgcaacctgatcaggagtgactttttgagatacttcgagatctactgtggctgctcctgcgactcctacttcgtgaccatcttctagatctatacctggatctgcttccagaatcagatcgcctatggcttgtgcctggcttaccttcaataagcctaatatttctgcaccatccagtttgtccaaagcaagcttcatgtcaaaataggagtgaaactcaacgccctcacttgtgcattccttgtgagcatcaacataggttacttcatctgcttgttgcataaaatcctttaaatcttgccaactgtaacaactagaaagactttctataataagctcgtattctg

SEQ ID NO: 401522 - DNA, 541 bp, Homo sapiens
tggaaagatacacacaaaattcaggatggtaaaagaagaaagatcgggacagagacctgcttggagatttctcatactcatccttagatctgctttgagaacaagaacaggagcccagatcagatttgggcatagatttgctccttgagctagatttcctgccttttgaacgagaacgtgatcgacctttgctccgcaacctgatcaggagtgactttttgagatacttcgagatctactgtggctgctcctgcgactcctacttcgtgaccatcttctagatctatacctggatctgcttccagaatcagatcgcctatggcttgtgcctggcttaccttcaataagcctaatatttctgcaccatccagtttgtccaaagcaagcttcatgtcaaaataggagtgaaactcaacgccctcacttgtgcattccttgtgagcatcaacataggttacttcatctgcttgttgcataaaatcctttaaatcttgccaactgtaacaactagaaagactttctataataagctcgtattctg

SEQ ID NO: 401523 - DNA, 519 bp, Homo sapiens
tgtgggcaaagcgcttcgtgggttgctactagatgaggagaaggaaatgattagcatgcacaaaaaattccgcccagctgccaatatggcaccgttcggtgactaacatcccaaaactctcagtaaaggtcaaccttccaggaagttctgagaaatgcagcttttcatgctaatttcctgggctgactccgtgactaatcagcccgtctcacacccagggagaaatcctgcagcacagatagcctcctcctctgcccccatcaatctctgtagaaggaagacattcagcaaatcatgctgctcagcatctaagctcattctccaaagaagggtcgcccacccatccttctattgctctcgccctccttctctccatccaacaagtaccaagtgtccaccatgcatccgtcagaagacattcagcaaatcatgctgctcagcatctaagctcattctccaaagaagtgtcgcccacccatctttctattgcaccctccttttttccctccatccaacaaa

SEQ ID NO: 401524 - DNA, 351 bp, Homo sapiens
atccctccttaatgacgtgccgatcattagatacctgcgtgtcaataacgtgctctgatgctatgtaccactgacagtcacaccgtgcccctccatctgcttttgttttgaccctatctttgaactttatcttggttgccggccagtagttttccctttaattacaagaaggaaactgtcaataaaatctgttaaatgggatgcaatgagtggcttgaatgggcggacggctatttgttcaaattctgcagcattcaaggtattgacagtttgttttctggggccatatgtgacgatcaatctcaggctgggctcagccgcgctgaaaaatgaaaaaccagattgcttttg

SEQ ID NO: 401525 - DNA, 534 bp, Homo sapiens
ctttagtgtttaatcaagaagcattatattaatagttgggatgactgatgtacctgttagaattttctttttgctcgtaggagcatatctggatttagcaggctttaaaatttcaaagcagttaaaatgtgcatgatattcatatgttagggaggagttaaattctctcaattgggagaaactaaagaaggactttccgtgttactagaactagatattggactgctgaaaattgaaagaccaattgatataccaatgggaggtttgtgtacagtcagtgaaattgaagaacatttatgtcattaatggacttacatagctattggaagccagaaagttatggtagatgtggttcttacagagttgataggcaagacttattgggagcactatcgtgatagctgatggtttggtaacattaataatagtaaaagcatgttatagtgggtattttttatgttggcacgaattggagacctgagccagtaaaagcagacgctgggctctaagagatacagatgtgaaggatatatt

SEQ ID NO: 401526 - DNA, 377 bp, Homo sapiens
agtcagaggaaaagctggaaatcaggctcagatggtcagacacccaggcccacacactgagcgaccccaccacactgcccccacccaggctactctagaccacagggaggtcagcccaggaagctagagcagctggattgccaaggctactctagaccacagggaggtcagcccaggaagctagagtggctggattgccaaggctactctagaccacagggaggccagcccaggaagctagagcggctggattgccaaggctactctagaccacagggaggtcagcccaggaagctagagcggctggattgccaaggctactctagaccacagggaggtcagcccaggaagctagagcggctggattgccaaggcta

SEQ ID NO: 401527 - DNA, 417 bp, Homo sapiens
cacacagccctggttctccagctgttctgctgctgtttctgtgctctccctgattaagagcattcagttcctgggctctccctttgagcaggaaatggtgaaagcatgtggctatggtatagcccacagggctgagatttgctgggattacaggcgtgagccaccacgcccggcccacttgcacattttcaaagtagtccacaaagctgtagtttctaatagcttcatagttcacatgtaataggggttctctgtgtgtttatagagcaggctactacagtggaactgttcctgtttcatctgacatccggatagatgccagccacccccacattccaaagtgagatttctgactagcagtgacttttctagggccacgtggaaaagttgataagtatccttttctgcaggacagag

SEQ ID NO: 401528 - DNA, 206 bp, Homo sapiens
ccctcttcaaaacctgcctccactgcttcctccgccctttcagctcccattctctcaccagccccctcagtccaggcttttattccctccccacagccctggttttccttctatctcactcacactcctttttagttcctcctcctctgccagatctctaaaagctgggaataccccagaattctgtcatcaggccccctcctcta

SEQ ID NO: 401529 - DNA, 472 bp, Homo sapiens
ctaattttggtatttttgttgagatgaggtttcgccatgttacctagacaagtctcaaactcctgggctcaagtgatctgtccatctcagcctcccaaagtgctgggattacaggtgtgagccaccggcctcagagatctaaaacaagatattgtattttaattgcacaggatgcaattaaaaaagaaaacattcagaaaacaagaagagctcttagaactgaaaaataagttagtgtaaaggttggaagataaaattgatactaacctgaaaagtattagaaagagaaagaaataaaaactaagagtaaataagaaaattagaagattagtcctagagaatcagtatccaactaagaggttcccagtgggtgatacagagaaaatgaatgggaggaaatctcaaggaaatgtatttcctagaactgaatgattggaatttccagtttagaaagaaggaatctagtgccagc

SEQ ID NO: 401530 - DNA, 368 bp, Homo sapiens
ccttggtgagtactggctctagagctagtttgctttgttaggactccagctatgacacttggtgagtgtaggcccttcaattaacctctcgtaaccccaattacctcctctacaaaatagggtaatagaagtacttcccccactgggtcacagtaagatgaaaatacttagaatatgctctggtacacagtaggtgcataaatgttagcttattattatcattatcatctaaatgcattattgcgtacacaaaaataacaggtgaaacttaaggaatgaatgagtgaattgcattcattcacttaatcattcaataaacatccattaagcatcaactatgtgccaggcccagggccagagacttagga

SEQ ID NO: 401531 - DNA, 435 bp, Homo sapiens
cgcctctcgcttatgaagccatgagaagaaagagaaaaagagagcctggtgtggaacatgagctagctaatgcttctggcaaccatcatggatgaagaggtgaccttgaggatggaagccacatgccaggagagtgaagcagaaagacagaagaagcatggggcctggggcctggggcctgccaatcagtctggactcactcatatggaatggactgcagtcacttgagagagaaaaaaacttccactgtgtttaaacctctgtttggcttttctgtcacatgtagacatcaggattaccaaaagacacatcagattttgcctttctttaaaaagaaaactcaatctaagttcgtgtttttttcctttagtgatttgagagtgttaatttctatttcagttatattagtagttactataaaatgtctaacaaacg

SEQ ID NO: 401532 - DNA, 523 bp, Homo sapiens
cgcctctcgcttatgaagccatgagaagaaagagaaaaagagagcctggtgtggaacatgagctagctaatgcttctggcaaccatcatggatgaagaggtgaccttgaggatggaagccacatgccaggagagtgaagcagaaagacagaagaagcatggggcctggggcctggggcctgccaatcagtctggactcactcatatggaatggactgcagtcacttgagagagaaaaaaacttccactgtgtttaaacctctgtttggcttttctgtcacatgtagacatcaggattaccaaaagacacatcagattttgcctttctttaaaaagaaaactcaatctaagttcgtgtttttttcctttagtgatttgagagtgttaatttctatttcagttatattagtagttactataaaatgtctaacaaacgaaaaaaaaatggcctcaataggcctaaagggtggagctctgaggtcagttccctttaaaaaaaaaaaattggcctccttggcctaagg

SEQ ID NO: 401533 - DNA, 768 bp, Homo sapiens
cgcctctcgcttatgaagccatgagaagaaagagaaaaagagagcctggtgtggaacatgagctagctaatgcttctggcaaccatcatggatgaagaggtgaccttgaggatggaagccacatgccaggagagtgaagcagaaagacagaagaagcatggggcctggggcctggggcctgccaatcagtctggactcactcatatggaatggactgcagtcacttgagagagaaaaaaacttccactgtgtttaaacctctgtttggcttttctgtcacatgtagacatcaggattaccaaaagacacatcagattttgcctttctttaaaaagaaaactcaatctaagttcgtgtttttttcctttagtgatttgagagtgttaatttctatttcagttatattagtagttactataaaatgtctaacaaacgtatttgtacatttatttttgaagaacattaggaccttgctactccaagtatgatcccctgatcagctgtgtcagcatcactggggagtttttacgaaatgtagaatctcatgccttacctaggcccacagaaacagaatctcattttgacaagatcctcaggtgatctgtgtacatattgcagtgtgaaaaccactgctcttgagactggcgtcccctctacttccatgagaccattatcatctccacagcatccaattgtgtcagagttaagaaattgtctcatgaattctaaaaatgtagatgcagctctcctgtgtccttactactgtcc

SEQ ID NO: 401534 - DNA, 718 bp, Homo sapiens
cgcctctcgcttatgaagccatgagaagaaagagaaaaagagagcctggtgtggaacatgagctagctaatgcttctggcaaccatcatggatgaagaggtgaccttgaggatgagagtgaagcagaaagacagaagaagcatggggcctggggcctggggcctgccaatcagtctggactcactcatatggaatggaagaaaaaaacttccactgtgtttaaacctctgtttggcttttctgtcacatgtagacatcaggattaccaaaagacactttaaaaagaaaactcaatctaagttcgtgtttttttcctttagtgatttgagagtgttaatttctatttcagttatattagtagttactataaaatgtctaacaaacgtatttgtacatttatttttgaagaacattaggaccttgctactccaagtatgatcccctgatcagctgtgtcagcatcactggggagtttttacgaaatgtagaatctcatgccttacctaggcccacagaaacagaatctcattttgacaagatcctcaggtgatctgtgtacatattgcagtgtgaaaaccactgctcttgagactggcgtcccctctacttccatgagaccattatcatctccacagcatccaattgtgtcagagttaagaaattgtctcatgaattctaaaaatgtagatgcagctctcctgtgtccttactactgtcc

SEQ ID NO: 401535 - DNA, 385 bp, Homo sapiens
cgcctctcgcttatgaagccatgagaagaaagagaaaaagagagcctggtgtggaacatgagctagctaatgcttctggcaaccatcatggatgaagaggtgaccttgaggatgagagtgaagcagaaagacagaagaagcatggggcctggggcctggggcctgccaatcagtctggactcactcatatggaatggaagaaaaaaacttccactgtgtttaaacctctgtttggcttttctgtcacatgtagacatcaggattaccaaaagacactttaaaaagaaaactcaatctaagttcgtgtttttttcctttagtgatttgagagtgttaatttctatttcagttatattagtagttactataaaatgtctaacaaacg

SEQ ID NO: 401536 - DNA, 416 bp, Homo sapiens
atctttgtttctgtgcagttccacccttcacattcccaaacagtcatttactaaccgttttctgagcactgggcctattaattccccaattttcctcttcactgtgtcacacagacttcctatcacactgtttaggatggaatgtcaaatacactcttttaattggaaagaaaatgtaaacaagctgtaaagaaaagaaaacaggctgtacagaaaacacattgtaactcattaaattggtatagttcataagccagccttatttagagaatgttataatcccactaaatttctttgtgttctgcctatataagcaagatcgtaacttgagagcattgaccccatttctctggagtctgtgtttcctggatggtaacttccagcgttttactcaaataaactcattaaaactgaat

SEQ ID NO: 401537 - DNA, 384 bp, Homo sapiens
aggatatttacgattggggaaggaagcatagcgtggtacacctgaatcaggaggactgtgaagggcggcagtgaggagtgaaaccagagcctgaaattgccacacttcctccgtgtctgactcggtgcttctcaaactgagcattttcaacatctttgacaaaacaattcagccacggaggggagtcttgcgcattgtaggatgtttaagccagaattcctggcctccacccactacatgccagaagtaacttaccccaaccaagatgagattagccactggcatgaaggaaataaaatattagaacttctatgtatttttatttgattacaaaacatagaatttaagttttattaacattgatgatgcccagacataatccaa

SEQ ID NO: 401538 - DNA, 339 bp, Homo sapiens
tcattgtccagcccctgctgtgaaatgtgaagtcctaagacacaggctttttttgtttgttacgttcattgctttagaaggaattaaggacaagctaccccaaatgacgtcactttggtatatggattattttgagctgcaggcactggagaaacagcaggtgcaggcagggccttcggacctccccttttctaaccaagaacaggccatgacatttcccacgagatacacactccctttgtaccaggaagagaacatccttatcaccaaacactgggagtggatgccgaggtgcatctgcacaaacacacttaataaaataaccctttgcttccacca

SEQ ID NO: 401539 - DNA, 1127 bp, Homo sapiens
tcaggccaccgagggcccagaggcgaagtagtgcagccaaggtcaccagcaagggactaggagatgggcagtgaacgcacccctcagcggcccgactggaccaggcaggcgtagctgcggagacgagggccgttggaaaaatcccagaggacccagagagaactcaggctgggactgtatccactccaggagtcctccctgttagtctctggtgcctgaagcccagatggaaagagatctgtgcacataggtttccacccggcttccctaacccggagggtttggtagggcttagggctgctgcgccagcaggacctgcccgcagggcactccgaggctggacaaggagatcggaggccggtgcagcctgcttgagctgaccagacacggagaagggaggcccgaggcgacagtcagacagctcctcttacctggacccttcaggaaagcgttgctggtggggggtggggggcagggccaaggccaaatcgattttctttaggattttcagtgagttaatgagagagtggtatgggcaaagaggaacctgaaagccaaggagcagcagaagcctctggggccacgataaaaataggatatttgcccaggaactcagcatcatcaataagtgccataaagcatccctccccttcaaacaaggcaaacgtatttcaactgaaaatggcaccattgggtggaaagtaggaagggagatggttttccctgggtgggttatgctgtggctggtttaggtgaggtttggggagctctttctgatgtaagccccccaccccaaggacggacctctgtaatatggggaagcttgggcttctgtgggccgactcatcttgaaatgagctttgatactcatgtttccacacacgtagaactgggattcagaagtagagggatcccaaattttaggaggagagagacttctgttagtgctgggtcccatctggcctgcttggtgctatgactgaatgtgtcattccggcatacttccagagttctctctggagtcagtattgggtgatgggactgaattgtgaagtgaatggagaaataccacctaactaggtttgtttgaaaaccagaggtaaatggattttttcttttcttttttc

SEQ ID NO: 401540 - DNA, 333 bp, Homo sapiens
tagtgaatttctgtgaattctggtacctttgtcagtcatcacctttgtcaactctagacacactgactaaattgagtttataaaactacaaattgaggcctgataggatcagggtgggaaaggctctcttggagccactcgcacatataaatggatactccacctgcccagggagggttctgccaaactatccttcagatccctggacagtctcagaatgcaggttccttaaactgttcatcacccagctgaatgcagtttaaatatgctgatccctcccacataaactttctgtttctatgtagctattaaacgcttatctattgagtaaca

SEQ ID NO: 401541 - DNA, 336 bp, Homo sapiens
tcatggacccagaaatgggtctcaggcaaggccactgttgtgccctcctaagcatgagctgtagcaacgtcagcatccagtccaactgggctaaactcgggtccagctgggaacttctgtgcccctaggggcccagatctggtgaattatttttctacaaagatttttattaataagagactggagatactacatagatgcgtctttctcttcttccctcaaggaactgatctgctatctgtggttctgagtaaactcatagacatatcacacgacagagaaatcctatttgttttctttgaaactatgctcagtttaataaaaccctacctttta

SEQ ID NO: 401542 - DNA, 546 bp, Homo sapiens
agtgcatttcacacagctctcacccgaaagagataggtgtcttctccattatggggtggatatcttctcttactgctgattattacagaatttcttcttaacattttataagttataacattttataagttattacagaatttcttcttaacattttataagttataacattttataagttattacagaatttcttctaacattttataagttaattttgcttttgagtaatgttttcttgggaactggaaaatactttcttaatctttaatttgaatgtttatcaccatctaatccaccgaaagtgtttctgcaatggaaaataagaacactattgtattgccccactggcacatacccatagtccatctgagcctaatactctgttctgggccctgaaggatattttgagagaatatctgattgtttgcccaggtttcaatctcagaagagaactgggatgccttccaacacttgtgaagctattggcattttcagtcaatcccactcttgggataatgacttattaataaataatgatcactc

SEQ ID NO: 401543 - DNA, 357 bp, Homo sapiens
catcctgatcatgctcaaggtccttggcgtcatctactttgcctgaagcagctgggctggggccgtccaggaggaggcagagctgctgcttctccaggatcatcatgaacagggacaaagcgtttcctactgggagacccatgggcctgggaccaaggattacattaataaaaatgttcccttggtgtcatgcatcaagggctaccagcagcagcacacacatgccgtgtggcaggacagagcaaagtccattcgccattacagaaagtatgcaaatgagaacatctgttcctttacaaaatgagtcattttctccaaatggctgcactgcataaacactttcactttaaatttaat

SEQ ID NO: 401544 - DNA, 292 bp, Homo sapiens
cagctggggagggcggggttggatcagcgcctgctcctccgccttcgtttttcccctccccctaaggattcagttcccccttctgaaattcaccaccttgtatgtgacttaatccagccccatgaaactgtctgagagcatgagtgagggtcaacaaacttgcttcccccaagaaaaagggtggaatcagagaggtggtgggaagggtttgccttgctttgtcatcgcttatataaccataaaaggttgtcaaggacgcctgcaggttagaggcctggcaaacaggaagtaa

SEQ ID NO: 401545 - DNA, 1876 bp, Homo sapiens
acttgtgctataacagtgtcaaaaccaggtgtacgtcgattccggatctgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401546 - DNA, 2269 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401547 - DNA, 2321 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401548 - DNA, 1592 bp, Homo sapiens
tgcgaggctgtctggtccgaagtcgtttgatcccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401549 - DNA, 1368 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401550 - DNA, 1000 bp, Homo sapiens
ctgactcctagaggtatcccgggagtgagagagaaagccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401551 - DNA, 1911 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtgaaataagaaaaacaatatatgaatatctcaaattcacgattatcgagaaatgacaagatatggcactataaaagataaatctataaaagtctctcttcttaaaaggtattaattgataaacatggatccagatgggtgagatcatgattatggcctctattatattaggagttccagccagtagccgatatagatcaatgaacagcataaaaactgcgaacaaaaaagctcagttcccctagttcacatacacagcagagtct

SEQ ID NO: 401552 - DNA, 435 bp, Homo sapiens
  misc_feature (12)..(12): n is a, c, g, or t
ggtgcacccaantgtgatctgcgatggctgcaatgggcctgtggtaggaacccgctacaagtgcagcgtctgcccagactacgacttgtgtaggcagcccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401553 - DNA, 480 bp, Homo sapiens
gcaaagtttcaagggggtgcaagagagggtctccggtttggaagtcaggggcgcggccattccaggaaaggaaactgttaaaggttaatgcttctcatacctaacaaatcctggagggcagccagcaccaacactcagggtgctgggaaaaggtgcgtgagagatctgaggcatctcgggggcaggggagggctgggaaggcaggctggctgggaccctcgcatcttaacctaaccttgaccctctttccatgagcagagttccgatgccctggaagcctgggagagtggggagagatcccggaaaaggagagcagtgctcacccaaaaacagaagagtgaggcttccagggtgcagcaggggtgggaggtgatcaagcagcgtggggattgtaagcccgagtcagggtgagggtggaggctgccaacagcacaacgggggaaagtggatgcggctgagattccctccttctctcctcag

SEQ ID NO: 401554 - DNA, 516 bp, Homo sapiens
ccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401555 - DNA, 2369 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401556 - DNA, 2214 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401557 - DNA, 1650 bp, Homo sapiens
ggagaggcgggtgtcgaatcggccgaggcaacttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401558 - DNA, 1561 bp, Homo sapiens
gggctggtacggtccggagtttatggatgggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401559 - DNA, 1598 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401560 - DNA, 2188 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctgggactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401561 - DNA, 2249 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgat

SEQ ID NO: 401562 - DNA, 1531 bp, Homo sapiens
ctcggacattcagcaggtgctggcacaggccctggctgggaggtggggcgggcaggagccagcctggaggaggggctgagagtcagcaggcacacgggaacccggaaccctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagagtggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacacctcggggcccactggaagcatc

SEQ ID NO: 401563 - DNA, 174 bp, Homo sapiens
atgtctggctggcaagaactctacctttagtggcaaaatgggggatggaaggattgtagaattgagctctaaggatagaacaaaaactgctctgaatattcacatttcctttcttttgtctctcaaatgttgttgtaaatgaaattatgtcagagtaaaacactaataaaccaa

SEQ ID NO: 401564 - DNA, 502 bp, Homo sapiens
tcagcacttcgggaggccgaggaagaatcagtagagcccaggagttggagaccagcctgagcaacatagcaagaccccatctttacaaacagaaacaaaacagataaaggtcgggtattccttatggtacatattgtataatgtggagactgctaactgaaaaaagaaaaaaatgtataaaaaatatgtatttacacccatgttcattgatgcataattcacaatagtcaaaaggtgaaagcaatccagatgtcctctgtggaatgactggataaacaaaatgaagtatagacctacaatggaatattattcagccttaaaaagaaagaaaattctgacccatgccacaacgcggaggaagcttgaagacattatgctaagtgaaatacaccagacacaaaaagacaaatactgtgtgattccacttagatcagatatctaaagtagtcgaattcatagaaattgaaagtacaatggtgattgccaggggctgagaaaagga

SEQ ID NO: 401565 - DNA, 505 bp, Homo sapiens
tcaattttcactcttgtataccaaagtgatattattgggccttttaggtaatattgtattcatcttagcgtatgtctgtcatgtaaaagcaaatctgttttcatgtatgtatctaagttgttcatgtttttatatctatacataaaaccaaaacaaattccataactattttctttgatacaaaaagcacttaccaagtatgagaaatttctgtttggttgtaggcatttagtggaggaaaactgttttgtggaccaaaacatgttatttctttaacattaatgttttagggagtggtatttttagtgattctttccccttgtagctttccatgtcttccacttttcctgtttgggaaagtactgctgttataatggaggaggtcctactttatgttaaaacaaagaaaagtggtccttttggtaagctttctgtcaagtccagatctaacagttctccaataaaatagttctcattccagagagcagatgaatatatttatgga

SEQ ID NO: 401566 - DNA, 432 bp, Homo sapiens
  misc_feature (418)..(418): n is a, c, g, or t
gattttagtagttgggaaggagatttaagcttcaaaacctcagtttcttgctcaacatctactcactatattattctatattattctcttgcttttattccaccatgtctctctgggcttgtgtcttctactcacattattggtttgtttcctaaagtttaaaatgcgatctcaagagatttcataaatatataaaagggggaaaaaaagaaggaaaacaaaaaaggaaaatgagaaaaaagggccttagaagagtctcatttaagatattatgactatattttagcttaaagttccaattaattcttttttttgtttttttcagatggagtttcgctcttgtcacccaggccggagtgcaatggtgtgatcttggctcactgcaacctccactgtactccagcctgggagacacagntagacaccatctca

SEQ ID NO: 401567 - DNA, 314 bp, Homo sapiens
tcagtaatgaaaaataaaacagttccaaaatagcactatgtggacaacttgaaagccatccatatttacaatatcagaaggttgcagttttacctaacactactgatttattcaaggttaggagcttgggcttttaaatcagagagacatgggttgaaattctgcttttgtgcattacaagttgtgggatttttggcaaattattagaaattaacctccaaaagcacagtttccttatatgttgaatagggataatcatacctattgtgaggttgagaggattaaatgaaatcatgagtgtaaaatgcctggaa

SEQ ID NO: 401568 - DNA, 373 bp, Homo sapiens
tgcagcctccacctcccaagttcaagctattctcccacctcagcctcctgagtagctgggactacagccacgcgcctccacgcccagctaatttttgtatttttggtagagacggggtttcttcacgttggctaggctgatcttgaactcctgacctcaagtggtctgcctgcctcatcctcccaaagtgctgggattacaggcgtgagccactgcacccacccatgctctagtacatcctaaagaatgcctttagttcctctttcctgacattactctgcttaaattccccagattcaagctttttgagaatcctatctcagcattttgggcatcaggccatgttatatataggtcacaaactcctagcctt

SEQ ID NO: 401569 - DNA, 445 bp, Homo sapiens
cagtggcttcgtgaccgaaaggccctgaacccaccccgaggccccacagctttttctccagctcagacactttctggggctcagtcttgctgcggcccttgtggcatttggcaggcagtgggtggaccatgagtgagttaggaggccgaactgcccacctctacaatgggttcccaggagagcgaacacgggacccgctcctccaggcctcagccccactctggaatgagttcaacagcaaggtacggtgagagctggcggcttcatttttggaaccagggggagagagagagagagagaggtttatgagagacctcatgagacagctcatgatggaagtgagcctgagctgcagtgaaccctgtcactgaagagacagccttcacactgtgtcttgcaggggaaaatacaactctttattaaaatttattgccctgaaaaaagg

SEQ ID NO: 401570 - DNA, 643 bp, Homo sapiens
aggaacgtgtctttgtgcaaagggaaggcagaggaaaggggggccggctactgccactcaagtggcttcatccacagctccagggcctgctcccgaccaggaccacagaacaagggaacctgagcgaatagaaagccactgagacctgctactactatacagatccttagcccatctccaaccttgccccactgagagagtgcagcagtcaggggcccatcagagaccaggtgtgtaggagctgagagatggtaactgttccttcttcatggatgctcacagtagcacctttggatagccctgcttttgcttctttcaggtacaattatttccttagcaaagacccaggcttgctttatctttccccacagtggacaagtaaggatggcactcaacctctcactcaatggcaggtgaccatcattcagttacactacatcagttacactacatctagaaagatggctgcaacctaccacaatggcaaaagttaaaaatgagcaaaggaaaaatctctgcttcataccacagagcactgtgtataggcagcatggtttggagggccacaagagggccatttagtggagccaaggatatacagatgtgttcatggtttagcctgaggttatggagggcccggggg

SEQ ID NO: 401571 - DNA, 217 bp, Homo sapiens
gagtgtccgcacggcaccaccccgttagcagacttggcttcccctgcagaggataggtcagcaagagaaacatgaacgggggctgccatgatggtagcgtctcacagacactgagcttcatagagaccaggtctttgcgcctaggagactgaagcagagctcagaagtttcagcaaagtccaggtcttactctcctgaagatccacagttttctgtt

SEQ ID NO: 401572 - DNA, 520 bp, Homo sapiens
cagacgctgcccttcagccctgccatttcagccagcctcagcgtcgctgtagaggcaggccgccctttctgccactgtctggctgggctgggccgtgggagtgctggccaacgtgccaggcagggaggacctgaattcctgaaggtggtggtggcagctgttagggtccacaggttaatgatctccaacgtcacacagaagagaatgtgctgaggtgtgacctccctcaccctgccttggctgcgtggggcaccgtctctccaggactcaccctgccccccaatagactgaagtctgaagatcagcccagtcttccttcaggcctcaatgccctctcacttccccagcccgagggactcctggctcttctcggaggctgctctgtggggtccctcccttgggcctttgctaatgctgtgccctctgcctgtgccagaggtgggcctgggcccgtttctcagggagctcctgaacaccaagaaattgaattgctttgtaaataaacaaaaagtgccaaaca

SEQ ID NO: 401573 - DNA, 764 bp, Homo sapiens
cagacgctgcccttcagccctgccatttcagccagcctcagcgtcgctgtagaggcaggccgccctttctgccactgtctggctgggctgggccgtgggagtgctggccaacgtgccaggcagggaggacctgaattcctgaaggtggtggtggcagctgttagggtccacaggttaatgatctccaacgtcacacagaagagaatgtgctgaggtgtgacctccctcaccctgccttggctgcgtggggcaccgtctctccaggactcaccctgccccccaatagactgaagtctgaagatcagcccagtcttccttcaggcctcaatgccctctcacttccccagcccgagggactcctggctcttctcggaggctgctctgtggggtccctcccttgggcctttgctaatgctgtgccctctgcctgtgccagaggtgggcctgggcccgtttctcagggagctcctgaacaccaagaaattgaattgctttgtaaataaacaaaaagtgccaaacaagcctgcctgtcacttgggagatggcccgtctctgccccaccaaatttgctaatcaaacaaataacctaaaatagaatagaaagaactcatctagacttttcttgtacctctgctccccaaacagcttctcttttcaggtctccggagcagccctgttctctctagcccaggcctctgtcaaaaattcagcctgaccttaattaattaattattattatttttaattaaaaaatttttaaatat

SEQ ID NO: 401574 - DNA, 468 bp, Homo sapiens
gtagctgactgactctcttattaccccgctcagggctgggccgtgggagtgctggccaacgtgccaggcagggaggacctgaattcctgaaggtggtggtggcagctgttagggtccacaggttaatgatctccaacgtcacacagaagagaatgtgctgaggtgtgacctccctcaccctgccttggctgcgtggggcaccgtctctccaggactcaccctgccccccaatagactgaagtctgaagatcagcccagtcttccttcaggcctcaatgccctctcacttccccagcccgagggactcctggctcttctcggaggctgctctgtggggtccctcccttgggcctttgctaatgctgtgccctctgcctgtgccagaggtgggcctgggcccgtttctcagggagctcctgaacaccaagaaattgaattgctttgtaaataaacaaaaagtgccaaaca

SEQ ID NO: 401575 - DNA, 474 bp, Homo sapiens
tttctcccctccccccccccccaccaaatcctcctcagcggctgggccgtgggagtgctggccaacgtgccaggcagggaggacctgaattcctgaaggtggtggtggcagctgttagggtccacaggttaatgatctccaacgtcacacagaagagaatgtgctgaggtgtgacctccctcaccctgccttggctgcgtggggcaccgtctctccaggactcaccctgccccccaatagactgaagtctgaagatcagcccagtcttccttcaggcctcaatgccctctcacttccccagcccgagggactcctggctcttctcggaggctgctctgtggggtccctcccttgggcctttgctaatgctgtgccctctgcctgtgccagaggtgggcctgggcccgtttctcagggagctcctgaacaccaagaaattgaattgctttgtaaataaacaaaaagtgccaaaca

SEQ ID NO: 401576 - DNA, 540 bp, Homo sapiens
tctcactctgctacccaggctggagtgcagtggcacaatctcagcttcaccgcaaccttcgcctcccaggttcaagagattctcctgccttagcctcccaagtagctgggattacaggtgccttccatcacacccggctaacttttttatttttactacagacaaggtttcaccatgttgatcaggctggtctcatctcctgacctcaggcgatccacacccccttggcctcccaaagtgctgggattatgggcgtgagctgccacgcccagcctctgtcctgcttttaagcaaacagagagaaagcagagaactctcctgcatcttaattgtctttagctcaaccatcttttatattttggagagttatatcctggtctctcacaccataaacaaccctaatgtccatcagtaaatggatcaacaaactgtggtacatccatacaatggaatactgctatgcagtgaagaggaatgaattcctgatacacacaacagcatggaggaatttcaaaataattatgccaagcaaaataatct

SEQ ID NO: 401577 - DNA, 550 bp, Homo sapiens
ctgacacggacacccactcgggagcgcaggctcacgacctttgttacatgctcacttcaccgcaaccttcgcctcccaggttcaagagattctcctgccttagcctcccaagtagctgggattacaggtgccttccatcacacccggctaacttttttatttttactacagacaaggtttcaccatgttgatcaggctggtctcatctcctgacctcaggcgatccacacccccttggcctcccaaagtgctgggattatgggcgtgagctgccacgcccagcctctgtcctgcttttaagcaaacagagagaaagcagagaactctcctgcatcttaattgtctttagctcaaccatcttttatattttggagagttatatcctggtctctcacaccataaacaaccctaatgtccatcagtaaatggatcaacaaactgtggtacatccatacaatggaatactgctatgcagtgaagaggaatgaattcctgatacacacaacagcatggaggaatttcaaaataattatgccaagcaaaataatct

SEQ ID NO: 401578 - DNA, 363 bp, Homo sapiens
tgtgcatgctcacttgctcattgtaaatggttagagagaaattgactgggctcatcagtgaagtttgatagcccttgctctatcccaggctgtttgggaggtggaacatagcagagtatcagagaatgaaaaccagtggctgcagggacagatgcaactaattgtatcatgaatgtgaatggaagggcacactctccaaacccccagctctgatatttaacattaagattcttcttgcaaagttttgtggttgttgagtgtggaacaaaaatatacttgcctttaacaactaatgtatttatttatttattattaattttgagatggagtttcactgtttttgcccaggctggagagcaatgg

SEQ ID NO: 401579 - DNA, 495 bp, Homo sapiens
tctggtaacccagtccatctggtcagctgaactctactcctatactgctttctattcactttccctgtccctcttccatactcttgactattaccatctacccagtcccctacaccaaatgttcactatttacacagcaaggaggcaaggaggcaaccaaaaaggaatcctaaatcttccctactccatatcacttaacttctacaaatcctgttttaagagaactgtaaaaataaaataaaattataaataatgccctagagaatattgagtgtgattcattttatctggagatgaatgggtaaatggtgactatgaggataaacttacagcagtggaagaatgaaagaggaaaaattaatgaagaaacaagatccaggctgggcacactggctcatgcctataatcccagcactttgggaggccaaggtgggtggatcatctgaggccagtagttcaagaccagtctggctaacatggtgaaacctcatctct

SEQ ID NO: 401580 - DNA, 728 bp, Homo sapiens
aaatctaattagaatgaagatacatagggatgattgtggcagctactctggaaggctggaagattccgaagtagacttacgcttttatgaaatgtaaagtgtatgatacatccttcaccacaaaaggcttcataaccttgaaataaataaaaggaatggaagctgggggcgggaggaggtggtagagtgtgtgtatttatgcgcccacacacagatgaaaagagagagaggcaataacagtgcttatgctacttacttgagagctaaagatcagaaggattaaagcaactaaatcaaaccaaaatttcataaatacacttcccaaactgaagaagattcaaaagacaaaaattaattttgtacgccaagtatgtagaaataatagatcaagagaatataaatgccactgaactgtacattttaaaattgttaattgagccaggcatggtggctcacacctgtaatcccaacactttgggaggccaaggcaggtggatcacctgagttagggagttcaagaccaccctgaccaacatggagaaacaccctctctactaaaaatacaaaattagctgggcatggtggtgcatgtctgtaatcccaactactctggaaggctgaggcagaagaatcacttgaacccaggagatggagggtgcagtgagccaagatcatgccattgaactccagcctgggcaacaagagtgaaactccgtctcaaaaaaata

SEQ ID NO: 401581 - DNA, 6545 bp, Homo sapiens
cccgagccagcaaccctgaggggcggccgggcagcgccgccaccatgttcctgggcaccggggagccggccttggacacgagtcaccttatctctctaagccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcgatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctgggctgggctgggccgggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggtcattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccacctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggcaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaagcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctaggaaagtagacaactcccgggggagacgaagtagagagtgagtccccaagaaagggactcctgccccagcgtcaagtgccaaagcaggccccatctaccacttcagggtcgacgttggtggcaggtgttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcacgtctgttgagctgacactgctgaggctgaagctggccccgtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttggagatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagcccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgcagtgtg

SEQ ID NO: 401582 - DNA, 5942 bp, Homo sapiens
ggcagttccaggggacaggagggaagatgtgcagagtcgtttgagtcccctcccctcgtgccctcctctctgttttaatgacttctgcctgcgccctggcttggcgggggtctgcgcgtgcctcacttctgattaaagagactgagcagggatcatgctcttccagtagcttgtgcccggcagcttctctgggtaactcgggtcccctcaaagctttctcatggccctgctggagactcagtttgccctggttcagtgtctcttttctgggtttggtaaatagaaagtagaaatgagaactagtatctaacacatgtctgtgttgcctccagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcgatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctgggctgggctgggccgggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggtcattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccacctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggcaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaagcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctaggaaagtagacaactcccgggggagacgaagtagagagtgagtccccaagaaagggactcctgccccagcgtcaagtgccaaagcaggccccatctaccacttcagggtcgacgttggtggcaggtgttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcacgtctgttgagctgacactgctgaggctgaagctggccccgtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttggagatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagcccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgcagtgtg

SEQ ID NO: 401583 - DNA, 6351 bp, Homo sapiens
cccgagccagcaaccctgaggggcggccgggcagcgccgccaccatgttcctgggcaccggggagccggccttggacacgagtcaccttatctctctaagccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcgatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctgggctgggctgggccgggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggtcattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccacctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggcaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaagcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctaggaaagtagacaactcccgggggagacgaagtagagagtgagtccccaagaaagggactcctgccccagcgtcaagtgccaaagcaggccccatctaccacttcagggtcgacgttggtggcaggtgttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcacgtctgttgagctgacactgctgaggctgaagctggccccgtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttggagatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagcccaacctagctcagatccaccaagataagcacagcaaagcttggctgcatttttgaggaataaaaacctgcagaaagcaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgcagtgtg

SEQ ID NO: 401584 - DNA, 6276 bp, Homo sapiens
cccgagccagcaaccctgaggggcggccgggcagcgccgccaccatgttcctgggcaccggggagccggccttggacacgagtcaccttatctctctaagccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcgatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctgggctgggctgggccgggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggtcattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccacctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggcaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaagcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctaggaaagtagacaactcccgggggagacgaagtagagagtgagtccccaagaaagggactcctgccccagcgtcaagtgccaaagcaggccccatctaccacttcagggtcgacgttggtggcaggtgttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcacgtctgttgagctgacactgctgaggctgaagctggccccgtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttggagatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagccccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgcagtgtg

SEQ ID NO: 401585 - DNA, 1627 bp, Homo sapiens
ggcagttccaggggacaggagggaagatgtgcagagtcgtttgagtcccctcccctcgtgccctcctctctgttttaatgacttctgcctgcgccctggcttggcgggggtctgcgcgtgcctcacttctgattaaagagactgagcagggatcatgctcttccagtagcttgtgcccggcagcttctctgggtaactcgggtcccctcaaagctttctcatggccctgctggagactcagtttgccctggttcagtgtctcttttctgggtttggtaaatagaaagtagaaatgagaactagtatctaacacatgtctgtgttgcctccagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctggtaatttcattcatttggattctggcaccagggcagctggtctgctgaggtctcagccaaagagtggccacctccaggaagcccgggctgtgtcgggacggaagggaggagtgtcccatctggagctgcctctgaactaagcgtcgccttatgccaggaaggcccacaacagggccccgccttggcccagcttgtcctttgtgcctggaattgccgaggtccttgctgtctttattttttgctctcagctccaacaggaccgaggtggcttcctccttcaggccagcatttctcctgtttgtttgttgagtaaaaccgtgttattgtttccttttctactttgttaaagtccaaaaacagtcagtgaaga

SEQ ID NO: 401586 - DNA, 2701 bp, Homo sapiens
cccgagccagcaaccctgaggggcggccgggcagcgccgccaccatgttcctgggcaccggggagccggccttggacacgagtcaccttatctctctaagccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgcaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgcagtgtg

SEQ ID NO: 401587 - DNA, 708 bp, Homo sapiens
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401588 - DNA, 697 bp, Homo sapiens
aaaggccaggctggtaccggcctgagagtgtatggatgaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401589 - DNA, 351 bp, Homo sapiens
ctactactactaaattcgcggcgctcgacctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401590 - DNA, 473 bp, Homo sapiens
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacaagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401591 - DNA, 985 bp, Homo sapiens
  misc_feature (743)..(743): n is a, c, g, or t
  misc_feature (745)..(745): n is a, c, g, or t
  misc_feature (748)..(748): n is a, c, g, or t
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctaaaaaaaaaaaaaaaaaaaaaaaaaaaaaaaaaaananaanaaaaaaaaaaaaaaaaaaaaaaaaaaaaaaaaaaaaaaaaaaaaaaaaaaaaaaaaaaaaccttgtggcccgcttggcccaattgaattttaaactggacaaagtttatcctggcggcccaatttaggcttaatttgccacaatccccctatggggagcgttttaacattcaacggcccgggttttaaaacctgcggaactggaaccctggggtgtacccactttcccctttggctc

SEQ ID NO: 401592 - DNA, 665 bp, Homo sapiens
ctctctccacactgggacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401593 - DNA, 869 bp, Homo sapiens
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccgcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgcc

SEQ ID NO: 401594 - DNA, 596 bp, Homo sapiens
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccagagggctgtctggggtacgagctcgaatt

SEQ ID NO: 401595 - DNA, 841 bp, Homo sapiens
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacaccaggggctgaggccagctgtttcagggaggaagtaactccaaagttgagcaaagtctggagcctcaagttctgtgttcagcggggaggctggctctggctttctgagtcctgtgtgaactcttggctcttggtctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401596 - DNA, 538 bp, Homo sapiens
aaaggccaggctggtaccggcctgagagtgtatggatgaggcgaattcacttactgaccggcctgggctgctctgagacatgtctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401597 - DNA, 480 bp, Homo sapiens
tcggtacccggtgtttatcgatgctctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401598 - DNA, 792 bp, Homo sapiens
  misc_feature (496)..(496): n is a, c, g, or t
  misc_feature (498)..(498): n is a, c, g, or t
  misc_feature (501)..(501): n is a, c, g, or t
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagaggaaaaaaaaaaaaaaaaaaaaaaaaaaaaaaaaaananaanaaaaaaaaaaaaaaaaaaaagagggggggggcggcccaaaggattacccccccgggggcgccccaggaaaggcggggccccccatgtatgcggtgggacacaagtgggcccccctaagaggaggggggccgtagaattataaccagagacggggggcgcccgggagcaaaaccgacgcccgtggagacgatggaaaaaaagcgggcaacccgagggagcactggtgggtgggaagaccccatcttgaccaagtggtggcggaacaacaattgtgggacagccctacggtaa

SEQ ID NO: 401599 - DNA, 654 bp, Homo sapiens
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgtatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401600 - DNA, 1118 bp, Homo sapiens
  misc_feature (876)..(876): n is a, c, g, or t
  misc_feature (878)..(878): n is a, c, g, or t
  misc_feature (881)..(881): n is a, c, g, or t
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacaccaggggctgaggccagctgtttcagggaggaagtaactccaaagttgagcaaagtctggagcctcaagttctgtgttcagcggggaggctggctctggctttctgagtcctgtgtgaactcttggctcttggtctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctaaaaaaaaaaaaaaaaaaaaaaaaaaaaaaaaaaananaanaaaaaaaaaaaaaaaaaaaaaaaaaaaaaaaaaaaaaaaaaaaaaaaaaaaaaaaaaaaaccttgtggcccgcttggcccaattgaattttaaactggacaaagtttatcctggcggcccaatttaggcttaatttgccacaatccccctatggggagcgttttaacattcaacggcccgggttttaaaacctgcggaactggaaccctggggtgtacccactttcccctttggctc

SEQ ID NO: 401601 - DNA, 825 bp, Homo sapiens
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacagtgagacagggagcccactgggggctggaggaaaacagggagggagggaatttctttttggtggggcaaaatggacaggagggccagaagtttgacatttctgttgcctttcacctggtttgggagctgatgtgagctgagtctccacttctgaatctgctctgctccacagattgttatggatcccagggaatggatcccatgactggggcttgaggtggcagctcgcccatagaggcatgttctgagaccgaaagctcagtcagcccatgcattctcaggcttctctcccgggaaacttgttttccctttgaagcctgcccatgacaatcatctgggtctgaccttcccagggcagaaatattggctctgaggaaacccccgctgtggcctctagccttctctaggagctgttagacaaggggtgggaaattgctggcgtcttgctgagtaggctttaaaaacaagggggaaagagcagtgaaatgctttgatcccagggtcccctgctagatgaaggctaaaataatatctcccacacatcttgctagacctcattcttctctctctcca

SEQ ID NO: 401602 - DNA, 300 bp, Homo sapiens
cccccggaaggagagaaaaaagagagatggactgtggctgcatttcttgggtccttagagtgggctggagagacctagagggcccagcatgtggctgggaaactgttggtggccagtgggtaataaagacctttcagtatccctaatatgtgtgaggcactttctctcttcccattttgcctttggcttttctatttcttttcttcctgaggataccttctggctaaaattctctcatctgaggtccaagttgttggaagggcaaagagtatatgtttggagaagaaagttggagccccc

SEQ ID NO: 401603 - DNA, 667 bp, Homo sapiens
cctcctaactaatgagacacttctgtgtacctttaacttattgtcagcgagagaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401604 - DNA, 696 bp, Homo sapiens
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccagacctagagggcccagcatgtggctgggaaactgttggtggccagtgggtaataaagacctttcagtatccctaaaaaaaaaaaacagagagcaaaactccatatcaatttggctcctttttggcctca

SEQ ID NO: 401605 - DNA, 687 bp, Homo sapiens
aacttaggctaggtacgaggctgggtgtaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatcccta

SEQ ID NO: 401606 - DNA, 763 bp, Homo sapiens
tggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctaaaaaaaaaaaacagagagcaaaactccatatcaatttggctcctttttggcctca

SEQ ID NO: 401607 - DNA, 531 bp, Homo sapiens
tcacgcagagcattcgcctctcccctaacccaggccacctttccccataagagccctgcacttggcaaacagccatcaaataactgactccactccaaacagcccacccaatccatctacatctttccaggcatgggacatggacagtttttggctatttcaagtcttctctttccccctggatgtcagtaacagcagcagctaatacttctcaaatgcttcctctgtaccaggcactgtgcttagtgctttgcacaagtttctgttgtcctcatgctggactacagtcaggtattattagcatctctattttgcaggtgaagaaacaagcccagagaggttaagtaccttgtccaaggtctcacagctctagctggcagcccaggaactgaaccccagcagtccaactctacagagatgctcttaactataggtacatatgacctctggggtgtgggcttcctgatcacctactgtatgctcagtaggtgcccttagggactggactccagctctgtacttagggaccct

SEQ ID NO: 401608 - DNA, 253 bp, Homo sapiens
cccctcttggctacaggtactttaattactacaggagatcatagtagctacctcactggtcataagggttaaataagataatgtataagacagttagcacagggaatgagggaattgtcagggaataagtacctggtaattagtagcttttactattatctaataatagttcttgatatttacttagtgctttctaatgtgaaccatacactcctgtgtgcttatctccttgacaattgggtggaaatggcat

SEQ ID NO: 401609 - DNA, 372 bp, Homo sapiens
tgaaggttaaggaaaaacaactggatgagggaggtggggcagtgggagagctgaaaagtcaccagatctgttaagctgcggtcagacctaagggaggatgtggctgagaagctgacttttgatgaactcctgtctttactctgatgaaataaacaaggaagcctagaatgaagggcaggcagcccaagtgaattaaaagcattttgaggcatcttgccaagttctatttactcttatttcattaaaaatacagaaagagtagtaaatacaagattcagccttgctcggtttcaggatgtgggaggagaaatcatgcagctgtcttacatgaatctgctagaaagaagcaggtcacaggtgtgatctgtgtgg

SEQ ID NO: 401610 - DNA, 354 bp, Homo sapiens
ttgccgtgtagcaaatcaccacatattttacagcttgaaacaggtttatgagctcaaagttttgtaggtcaaaagtcagggcaggctcaactggggtctgtactctgggtctctgggtcaggctcaactggagtctgcactcccggtctccaggcctagcattaaggagtcagcggccaggctcttcttagaggctctgggagggaacccactccccagctcacccagttgccagtagaattcagctctgtagactgtagaatgggcccacttcccccatccttgctagtggtggcaggagtcactctcaggtcccaggggccactctctggacatgcacatggtcccctctgt

SEQ ID NO: 401611 - DNA, 634 bp, Homo sapiens
ccaaaagttgccaaatgcccccaggggcagaatcggccccaagtgagccccctactctgcacggaataacctgtggattttgatgtttccctgaccctgggttcaggccagtctctacccagggcagaccccacttgtgctgtccatatggcattttacagagtcccatttaaaaaaagaaatccccaggccgggcgcagtggctcacatctgtaatcccagcactttgagaggcgaaggcgggcaggtctcgagaccaggagttcgagaccggcctggcaaacatggcgaaacccccaactccaccaaaagtacaaaaattagctgggcacattggctcatgcctgtgatcccagcactttaggaggccgaggcgggcagatcacttgatgtcaggagttggagagcagcctggccaacatggtgaaacctcatctctactaaaaatacaaaaattggctgggcatggtggcgcgtgcctatagtctccgctacttgagaggctgaggcaggagaatcacttgaacccaggaggcagaggttgcagtgagccaagatcttataggagcaagactccctctctcaaaaaaaaaaaaaaagaggtcgctgaaagtgggagaactgccgccaacct

SEQ ID NO: 401612 - DNA, 106 bp, Homo sapiens
ggtaggtggggtgtctgtacttagagaacagaggagccctgtggttctttgctgggacagtcaccccaggagaggagactcaggcctcaggcacgccgagcccctg

SEQ ID NO: 401613 - DNA, 480 bp, Homo sapiens
gcgatcctctaacttgtgggggatttccataaaacagctgaatctctcttgggtcatctgtggcaaaagccagacacgtgctcacccgcctgggagccaatagtaacttttgcaaacgctgcctccggaaaccccacggtttgagggctgctgctttaggaacaacacagaaataacgtcttttaacagaataaaacaaaacatacggacgggatagtgagaaagcctttgtccttcgcagtggggagaggtgttaaaggtgaaccgaaaagagtatgggaaactcatgtaaaatacctttacagttccccgggaagaagggggcggagatgggctcgggagcgtctctggccctttaaggaggagggacagacataagagtctgtacctttaagagtctctttgtctggaaaccttcttatttaccctcctgtgcttcaaccaaacttcgaccagctattcacaacgtccccctacgcc

SEQ ID NO: 401614 - DNA, 462 bp, Homo sapiens
ggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagca

SEQ ID NO: 401615 - DNA, 380 bp, Homo sapiens
cagagaatgtgtgctccataactggagtgctgcttggcattagaaggggcacacacgcacaatgacgcggacagagctcaagtcatcaagctgacatccatgtatcggtgcaagaagccggcacaaaaaagtatattccctactaccccatttacataaaactgcagaagatgccagctggtcttaatgatgggttccataagccggttgccaggggatgggggaggggaggagagactgtccaaggggcaaagtgaacttttgggaggaatggaaatgccctaccttgattatggtggtggtttcatgttttcatatgtcaaaattcatgaaagtgtacacttaaaaccttgattaaaaagagtaactttggccaggca

SEQ ID NO: 401616 - DNA, 395 bp, Homo sapiens
ctggcacttggtaggtgttcaataaatagtaccgattgcggtggctgaaggcagcccccaaggtgggaaggcacatgggatgtgtggggagcagtaagtccatcagctcaatagcaagggagtgcttgaaaggtttgggatagacatcagattgtggtgggcagcctcaagataaactgcttaaactttatcaataaaacaaaaagtttctgggctcaggagtcacatgtgttgttgtataaaaaccactctaacaacagtgtgtggtagttaggaaagagacaacaggagcagaagaccagttaggaaacttcttatgaggaagaggagatttattaagccccttcttttaggctaggaggtttcctaatacagaattatctctttaatctgca

SEQ ID NO: 401617 - DNA, 365 bp, Homo sapiens
ctcctgagttgctgggactgcaggcttgtgccaccatgcctggcttctgcagggctttttaatccagtggattccctgggaattagattcagtcccaaccggagacctgaacaccacatcacagtgtctaccacaaccagggtccacagtctggcttcagggatgaccagggatctctgaagaggaaagcagcatccagcatgtgtgtgcatttacatgtttttctgggagacagtgtccttgacccccaaaagattaagaatcattggtctatggaaagccagactcattcaaaaccgtgtgatcagagatgtacatggtagttgttcaacaaatataaaaggacggatggatggataatcgat

SEQ ID NO: 401618 - DNA, 785 bp, Homo sapiens
aagagtcaaggatgattccaagggttggagcccaagcaactagacggatggtgctacgtttaatggaaaaagaggagacaaaggaagagcagacctgggggcagaggaaatctggagttcagctttggatattctgagtttgagatgagactgtcaaacagagcgtaaagtaggaagcctgataggaaagtctagaggtcagggagaaggtgtgagctggagatccatatttgggagttatcagcatgagagcttttcggatgttcttgatcagctagtggaatttttctccacccagctgcatgactgtttactctggagcaaggattcctgggcgtaaacctaactcctccactcctcaaaggtctgatcttggacaggctactcaactgctctcagtgtctgtatccccaaaagtgcctacttcttttattatgaggaaaaaatgaggcaattcgtgttaattaccttgcacatagtaataagcactccctatataataaccattataatcccctcccttcctctctccacctcttactaccttgctaagcttggtatcttcaacttcccttttttctcacctcatattcaactcatccctcaccctgagtgcccctggatcactgtccacgccagtgcctcactgcccctagagcaatcctataaacagtgttgattccaactgaataggtcgcaagcttctattttctactctcagaatatttcttaaatctgcctccctctctttgttttctcattatttcccatctgagttcccaata

SEQ ID NO: 401619 - DNA, 709 bp, Homo sapiens
catcttctgagccagtggtgtgagcaggtgggagactgctatggattgtgtggttggaggtggtggagccatgcaggtgatggtctgggcatgcactcgggactctgtgtcaccgagagttgggtctaggggcgagtagagaaggtctggcattgccatgcaaaagatggagccagttgggagtgggtgcataggagttctggaaagaaactgagaaggacagggcagagtgggaaggacacccgggaaagagtggttcccagacaggagggtgaggagtcggatagggcgccaaggcagccaggtacactttgcagccagattcacagctttgtcattactgcttccaggcttcataaagcagcagagaccccctttatgggcagagtcatgcccagactcctcagggatatagtgggtgacagtgcagcctcctcccagtgcctggttcatcccttgcagcctcgatgatatctgaagcccatgagcacccccagggaggtggagtgacaggggaggactcagagcgagctcaggactggtatccggatgcttagcccagaacccgccacacggaatctgagtcctctcccaaaactggatctcagcaaacttcccttgaaccactgcctgagtattcttgagaattccagctcctgagttacagacaagcacggagcctttcctcaaatctgcatcccctcctcct

SEQ ID NO: 401620 - DNA, 2520 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401621 - DNA, 2446 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401622 - DNA, 2650 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtcccttctccctgtgatcagttaccaactacctgttgatgtgtgtggttacagacttctttctatgctttgtacaactctacagaccgtatgtaggtattactgtttttgttttttgtttttacaaaaaaggaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401623 - DNA, 2785 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtgtgagtaacctctacctccgtccttctcgccgccctctcggggaccagcaccctcgctcctcagggtggtcgggagggagcacacgcacccgggcgctcacgagagggcggggactgtgtacacacgtgtcacaccagaccagagaagcatctccagggacaccggcggccgagccccgcgcacgcccttgagcacctgagctccagggcgtcccctcggactcaaggagaaaaaacacaccccgaggcacacgtggacacctaggaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401624 - DNA, 2462 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401625 - DNA, 1456 bp, Homo sapiens
acaattcggcacgaggccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401626 - DNA, 1957 bp, Homo sapiens
ctggtctcgaactcctgggctcaagcgatcctcccctctcagcctcccaagtagctgggactgcaggcatgcaccactgcacccagcatgaagggacagtttgaatttggacagggagccgatggtgagagcccaggatggcagagggaggccttactgctaacaaagactagtgtaatccagtttggccagaggtgggaagggcacgtgggaggaccagtggaggtcagatcagggagggaaatcaaggccaaatggtgcagtgccttaaacggcagatcttggggtttggacttgatttctcatgatgtcgtcactaggagttactgcagcttttggagggaagccaggcttgaggagggttgtgcctggggatgaatgtctggcagcagtgtgtgaggtcagctggagagggtgaggctggaggcagggaggcccggctgagagctactgagggccaggttcagatctgctgcccaagggggatcaggtgggatgggatgaagggtcagagatgcctctgggaagaggttctggagccattgctggatcctttggagccacaggcagccgttcttcctgggcaggaaggagcgctgtccagcttctgatttctaggcctgtcatctgttcagtcttaacccaattacagtagaaagaatgaaattagtttatttgctattttgagctgggcatggttgtccatgcctgtaatcccagcacattgggaggctgaagcaggtggatcacctgaggtcaggagttcaagaccagcctggccaacatggcgaaactgcatctctactaaaaatacaaaaattagccaggcgtggtgttgtgtgcctgtaatcccagctactcaggaggctgaggcaggagaatcacttgaacctgggaggcagaggctgcagtgagccaagattgtgccactgcattccagcctgggcaacagagtgagactctgcctcaacgaaaaaataaaataaaataatttgctatttgcattcatttctttgtccagcaagtacttcttaagatctgtgatgtgccaggggctgtgttgatgggagcagagcgggcatccatattttcatccctttcctctccccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401627 - DNA, 1739 bp, Homo sapiens
  misc_feature (1635)..(1635): n is a, c, g, or t
  misc_feature (1638)..(1638): n is a, c, g, or t
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggacccngtntcctggggcggccgaaggaggaatagcccaggaagggggggccttcgggcgtgccgggggagctgtcccctggaccacaggcggtccagaaagagacggtg

SEQ ID NO: 401628 - DNA, 1520 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctgggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401629 - DNA, 1451 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtgtgagtaacctctacctccgtccttctcgccgccctctcggggaccagcaccctcgctcctcagggtggtcgggagggagcacacgcacccgggcgctcacgagagggcggggactgtgtacacacgtgtcacaccagaccagagaagcatctccagggacaccggcggccgagccccgcgcacgcccttgagcacctgagctccagggcgtcccctcggactcaaggagaaaaaacacaccccgaggcacacgtggacacctaggaaaaaagtacatctcctggaagggatgctttttagctgagctctggtggatgagaggagctagccttgaaaaagtgagtaggggctgagagtggggctgtatttcagacgtagggaactggaggagtagaggcaaggcaattgataggagtgctccccgagttttccaggaactgggcagaagcagtcagaccactctggttaaatgagggaaggggaagagtggtccagagtgaggctgaagaggtcagtaggtctgagtcaggggagcccaggagcgtcattttcttttttgttttgttttgtttttttgtttttgagacggagtgttgcagtgagccaagatcacgccactgcactccagtctgggtgacaagagcaaaactctgtctcaaaaa

SEQ ID NO: 401630 - DNA, 2321 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacac

SEQ ID NO: 401631 - DNA, 2536 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtcccttctccctgtgatcagttaccaactacctgttgatgtgtgtggttacagacttctttctatgctttgtacaactctacagaccgtatcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401632 - DNA, 1771 bp, Homo sapiens
acaattcggcacgaggccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401633 - DNA, 1616 bp, Homo sapiens
aacttcggcacgatggggcagcgaataacacctaagttccagggtggcagtgagctgggtctgtgtctgtacttggtactcgggcgcttgatcatcacgttttgactgtctgtgtgatgtgtaacgaactgtgctcgtcgcagtgtggctttagacagcgacaagtggttccatgttatggtaaaccaatgctgaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401634 - DNA, 2388 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtcttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgatatccgctggacctcttcaagaagcggctacaggttggagggtttgagcatgccagagctgcctttggccaggtacggagatacaagggcctcatggactgtgccaagcaggtgctacaaaaggaaggcgccctgggcttcttcaagggcctgtcccccagcttgctgaaggctgccctctccacaggcttcatgttcttctcgtatgaattcttctgtaatgtcttccactgcatgaacaggacagccagccagcgctgagcgcaggaaggaccccaggtcttccctggaggcagcctcctgaaggaaggaagattcagtctccactgagaggtgccgtctggcccttccctgcaggccagctgccccaagcggggtagcagccttgaacccacccagctgggacaccaccagaaggtccagggctctccccatgagagaatcagagggaatgcaggacgtggtctatggtgagccaacgacacagtgagaaggagcaggaagttgctgtttctcctctgaccagcccacactgcaaaggaaacagacgccatcctacacctatcagccctgcctgccaggagaacagaacacactcctggtctggatggggctgctgcttgagtgcagagggctgcggtaggccctttgcaggagtcaggtccctacacttggcctgtttttccaacctatttaatagacattaaagctaaacacacattccttatcttactccatctcccctggcacatctgcctactcacaaagtatgagggaaaggactcctgccttcctcaaatcccatgttctccatagcggcagcccttggcagctctgcttctagtgctgggggagactccaggctgagccagtcactttctggcctgtgccgattctacccaagtcgtactagcctat

SEQ ID NO: 401635 - DNA, 1874 bp, Homo sapiens
gttggcaaggctggtttcaaactcctaacctcaagtgatctgcctgcctcggcctcccaaagtgctgggattacaggcatgagccacctcacccagctagttttttattattagtagagacagggtttcaccacgttggccaggctggtctcaaactcctgacgtcagatgatccgcccgcctcgacctcctgaagtgccggcattacagacgtgagccaccgcacccggcgccctgtagcctcttgatgtttgactcccctgagaagagcaacagaagaaagtcaaaatggctttttgctaggcttcctgccatctttaccaagttgagattatccgggttctggcattaacagagtttgaggaaagcgggtcaagtctaccgcgccctaaccttggaccccgcctgcaggctgactttcgagtcacacgccagagcacggcgacccctaaggtcgcagcccggcttcgcaaggcacctccttctaacgcgtcggtcgaactcgcgcgcccgcgagcagccggactacatctcccaggaagctgtgcgccgtccagctgtcctgcccttggtcgcgaaggactacattacccggtgatatcttgcgggaggcggttgccagacctcaagcgcacaaccattggtccagcgtctggcggggagctgcacggtgattggcccaggagcccgccagtttcgtccgagctcagtagagttttgctgttaagactgcgcgaggagctagagagagcggagagcgcggagccgggccgcacccgccgagccgtgaaaaaagtacatctcctggaagggatgctttttagctgagctctggtggatgagaggagctagccttgaaaaacttgatactgatggacattgtgtgggccagaggcagggatggttggctatgaccccaaaccagatggcaggaataacaccaagttccaggtggcagtggctgggtctgtgtctggacttgttactcgggcgctgatcagtcccttcgacgtcatcaagatccgtttccagcttcagcatgagcgcctgtctcgcagtgaccccagcgcaaagtaccatggcatcctccaggcctctaggcagattctgcaggaggagggtccgacagctttctggaaaggacacgtcccagctcagattctctccataggctatggagctgtccaattcttgtcatttgaaatgctgacggagctggtccacagaggcagcgtgtacgacgcccgggaattctcagtgcactttgtatgtggtggcctggctgcctgtatggccaccctcactgtgcaccccgtggatgttctgcgcacccgctttgcagctcagggtgagcccaaggtctataatacgctgcgccacgccgtggggaccatgtataggagcgaaggcccccaggttttctacaaaggcttggctcccaccttgatcgccatcttcccctacgccgggctgcagttctcttgctacagctccttgaagcacctgtacaagtgggccataccagccgaaggaaagaaaaatgagaacctccaaaacctgctttgtggcagtggagctggtgtcatcagcaagaccctgacatatccgctggacctcttcaagaagcggctacaggttggagggtttgagcatgccagagctgcctttggccagacggagatacaggctcatggactgtgccagcagtgctgcaaggagggcctggctctcagggctgtcccagtgtggagtggctctcccgggtcagtctctcggtggatctccgggggctccctggttaggaccccgcgtgggaggcccgttccggggggcctaggaggagattccgagggggggcgcctgggccggcccgg

SEQ ID NO: 401636 - DNA, 321 bp, Homo sapiens
gaaaggactcctgccttcctcaaatcccatgttctccatagcggcagcccttggcagctctgcttctagtgctgggggagactccaggctgagccagtcactttctgggccccgtgcccagaccttcgtgtctgcagacacaccaccacccaggctgtcctctcccaggaccgggctggtcatggccgtggggctccatggaaagcagatcccagcgcccgtgcaggaagtggatgggccatgctgtgggcaggcgtgggtgaaggtgcagcctctccccagtctacctcactgactcctctttcacccagagctgggtca

SEQ ID NO: 401637 - DNA, 346 bp, Homo sapiens
gcataagcccgatttgttctactggacttgttggattaaatgaacacaatttaatgttctataggacaagggctcctttcatggctgaaagaaggagcaagggtgatttacagtttcacacatactcattcgctacattatctgccttgtgcctgtagttatgaatatcaactcatcatccggcagccatttctacccattcaggagaatttagctttttattaggaggggctctgccatcccgaaagaaacaaagaacaaaaaacaacaatagatttccgcaatgttcactgaaaaacaagcaccaatatttggacccttgtacctcacctttttttttttcttt

SEQ ID NO: 401638 - DNA, 547 bp, Homo sapiens
ctggggcagacatcagcataacgtggtcacattttgtactttaagagtttgtgaacaccagtcttaaacagtggtatctgaaatgaagtcgccacccactggcctaaaacaatgccagtgaaaaagaaatgaatttatgaagattggccaaaagaaatgatgaatccagtaaagatttacagaggaagtgtttgcaaagcgaaacttacatctagtcctcaaatctgctgcctgaggaagagggggagctgctttctgctttcttaagcctttaggatctagagctgggaggggcaggcaggaggagagcacagccatctgtggatctgttcagtggcgctctgtgaactctcaagcaactcaaagctctagagtctggttcttctcaattacctcaggacacagtcaacttagtacctgctgtctggagcacgcacaggagcccctgactccttttttttttttttttttttttttttgggagaaatgtgggtctcctcgctgggtggcggggggggggtgtgaggggggggatctccctcccctc

SEQ ID NO: 401639 - DNA, 638 bp, Homo sapiens
  misc_feature (13)..(13): n is a, c, g, or t
tcttccacatcgnccgaaagaaccatcacaccacccgtcctaatattttttatctgctgacaagacacgggttgcagcttgccagggctgcctactgaatcactcttctatcgtgctgttcttcaggatattattaaagattgttatggcatcaccaaatgtgatcggcatgttggtaaaatttattccaaatgttcttcttttctggattatgtcagacggtctctaaagaagcttggattagatgagtccaagctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacag

SEQ ID NO: 401640 - DNA, 503 bp, Homo sapiens
tttataattagacattaatgtaacagatgtttcatttttcaaagaagtttcccccttttccctatctttttttaatcttccttagagcaataaatagtaattactatatttgtggacaagctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacag

SEQ ID NO: 401641 - DNA, 1012 bp, Homo sapiens
tctgggacaatgcagctgtgagggttcctggaagccctccaaactgggctcaccatttatgaggactatgacattctcttgtagaaaggatggtaagtgtttgtggtagcaatgggggctggtagtgttcttctgcttactttttccctgtaacaggaagtttctgctgctttggggcagatctcatccaatcagagaagatggagttacagaggctaggtgtctccaagctgcccacctggacttctaatcaccacaggtgcatctgcacttccctgctgcactccagtgctctctgttcaacactccaatcaaatctcatctgtatattcattgccttgtctctttcttgtatgggggaactggcatcaggcatctgtagtcagtcatcttgctaatgtcactttgcgttgttattttttttttccaggtatttctggtctgcagatgattaagtctgtgggtacagaacctgcagttagagaaggccagctgtatacttcttatgcgcttgtaagaacaaggacatttttagtttgatttggtttggttttttttacacacaggtttgcatatggtttcactgtttggggttctcccttggcttttttgcatcaaacatacttacaatgcatagtctatgatatccagttttggatctcttaaaacaacaaactttttttttaattttacagtaaaaaggtgttctcaccttttctttccagaatatactcaaaagcaacaaacagaatgagaaagagaaacaaaactctctttgacaatatcagaaggaatttgaaatcttaaactatgtatattacaaagtataatgaaggtaaaagagggatgcagaaagatgccaagaggaaatgcccacggttacagatctcagacaaaatcaacagaacatagttctctaaagtgtcatatcctgaggaacaaaatcaacagtctctagtttgaaacaaatacaactggtgaccagcatggtgcttcccaatttggcacaaca

SEQ ID NO: 401642 - DNA, 896 bp, Homo sapiens
tctgggacaatgcagctgtgagggttcctggaagccctccaaactgggctcaccatttatgaggactatgacattctcttgtagaaaggatggtaagtgtttgtggtagcaatgggggctggtagtgttcttctgcttactttttccctgtaacaggaagtttctgctgctttggggcagatctcatccaatcagagaagatggagttacagaggctaggtgtctccaagctgcccacctggacttctaatcaccacaggtgcatctgcacttccctgctgcactccagtgctctctgttcaacactccaatcaaatctcatctgtatattcattgccttgtctctttcttgtatgggggaactggcatcaggcatctgtagtcagtcatcttgctaatgtcactttgcgttgttattttttttttccaggtatttctggtctgcagatgattaagtctgtgggtacagaacctgcagttagagaaggccagctgtatacttcttatgcgcttctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacag

SEQ ID NO: 401643 - DNA, 544 bp, Homo sapiens
  misc_feature (13)..(13): n is a, c, g, or t
tcttccacatcgnccgaaagaaccatcacaccacccgtcctaatattttttatctgctgacaagacacgggttgcagcttgccagggctgcctactgaatcactcttctatcgtgctgttcttcaggatattattaaagattgttatggcatcaccaaatgctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacag

SEQ ID NO: 401644 - DNA, 715 bp, Homo sapiens
  misc_feature (13)..(13): n is a, c, g, or t
tcttccacatcgnccgaaagaaccatcacaccacccgtcctaatattttttatctgctgacaagacacgggttgcagcttgccagggctgcctactgaatcactcttctatcgtgctgttcttcaggatattattaaagattgttatggcatcaccaaatgtgatcggcatgttggtaaaatttattccaaatgttcttcttttctggattatgtcagacggtctctaaagaagcttggattagatgagtccaagctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacagaaggttataatccatttttccattgtcaaagcatacattaataaaagaagaacctgtcataataatataaaacagtt

SEQ ID NO: 401645 - DNA, 580 bp, Homo sapiens
tttataattagacattaatgtaacagatgtttcatttttcaaagaagtttcccccttttccctatctttttttaatcttccttagagcaataaatagtaattactatatttgtggacaagctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacagaaggttataatccatttttccattgtcaaagcatacattaataaaagaagaacctgtcataataatataaaacagtt

SEQ ID NO: 401646 - DNA, 401 bp, Homo sapiens
tttttgaaggtgtaattgtgaatgttaattttgtttaacaaagcataagaattttctgtgaaacagctttgtttttatgtattttttatattacaatatataatccaactcgcgtctaatttttttcttcaacaaatggttgtatatctaaatcacttattaatttacaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaac

SEQ ID NO: 401647 - DNA, 447 bp, Homo sapiens
gaagacggggacatagttggagaaactagtggggaaggaacgagagaaggttagcgtagccacgctgccagaaaaaattataatgaactactacgagaagtataagcctcgaatgaatgagctggaagcttttaatatgttgaaagttgtactggctccctgtatagagactttgattcttctggatcgactttgttacctgaaagagcaggaagatattgcatggtctgctcttgtgaagttgtttgatcccgtgaaatctcccagatgttatgctgttattgccctgaagaagcagcagtgatttccattgaagcaaattattagatgtatttctctatgagacctgttgctgagattgcttttctaaacatatatgtcctgttatacaaaaatttttaaatgactgttatgtattttaaataataaaataatggctaacaacag

SEQ ID NO: 401648 - DNA, 292 bp, Homo sapiens
tccttgggactaggggtccgagcaagacctgaattataaactgagcagccacagagaagcactacagatgtagctgagttatctaggcctaacaccaaatattctagaaagacccaaagtactaaccagctctggcagcaagaccagcccatgtctacctctgcagaactttgagaatctttggctgatttttattacctaactccctgtccataagagaagggaaagagaccaagactgagtggttggatcagccaaagatgtcaaaattaaacttcagttaaattagcaa

SEQ ID NO: 401649 - DNA, 384 bp, Homo sapiens
tctggcagttccctgcttttatggtgtagtcatggtgaaacctgagtcatctgaagatggtgcagtgccagagagcaggagagaggagctgcaaagaagccagacagcgttgggcatcaataactcctgggcaccacccgccactggccttcattctgacaggagagccaacccaaccctaactgtgttcagagattgctccaagctttacagttctaccaaattctttctgtagcaaaaatataaaggcatcttcttaggtaattttttttcagggttccaagtagcaacacctaacgtctgcagtgcgagttctcttcttcttttttttttaaggtgataaatcataacattttcctggaaaggaaagcagtagacctcatt

SEQ ID NO: 401650 - DNA, 555 bp, Homo sapiens
caatccacattaagaatatagtcgtctctcttttgaactcttctattaagaatgctgttagctaattacagaaaacataatgggccaatacctttattatatgaagatccattcaaactaattttaaaaaaagatctagtagattaatagagacatgaacaggaaattcatgcaagaagaactaatatatgcacatggaaaatgttctattttcctattagtcaaggaaatgcaaattatgacaataatattgagccgttttccatctcctgttttatgtatgtatatatgtgtatttgtttttattaaataataccatgcctgaccagctagctgtcagcttcttgaagtcaagattcatatatgatacatctctgtgttcctgctatgatcttatacatatttggagctcaataaatacgtcttaaattgagtaaattaataaattattatactagtggtttatgatgccctgtaaattttatttttcatttttaactgttttaattacaatgtttaactttttatttgaaatgaaaataatgaaaaaaaaaa

SEQ ID NO: 401651 - DNA, 1014 bp, Homo sapiens
caatccacattaagaatatagtcgtctctcttttgaactcttctattaagaatgctgttagctaattacagaaaacataatgggccaatacctttattatatgaagatccattcaaactaattttaaaaaaagatctagtagattaatagagacatgaacaggaaattcatgcaagaagaactaatatatgcacatggaaaatgttctattttcctattagtcaaggaaatgcaaattatgacaataatattgagccgttttccatctcctgttttatgtatgtatatatgtgtatttgtttttattaaataataccagctattgcccgggcatggtggttcacacctgtaaccctagcactttgggaggccaaggcgagagaatgccttgagggaaggagtttgaggccaggatttcaagactagcctgggcaacatggtgagaccctgtctctacgaaaatatttgaaaattagccaggtgtggtggttcatgcctgtgggaggctgaggtaggaggatctcttgagcccaggagttggaggttacagtgagctatgattgcaccactgcactccagcctggatgacagagcaggaccctgtctcaaagaataataataacaatgataataataccaggtattgttgccaaactgatagctcatgtattggtgttgacaatataaactggtgagtaattttaggaagtaaatcaatgatatgaatcacaccataaaaatattcatactcttaaaaataatcccatttttgagaatatttccaaaaagaaggctatatgtttaaaggtattcattgtagcatagtcttcataattactttagaacacttaagacttttaccatgttaaataaccctgtagtttaaaatataggcttatgggggaaaaaatagcaattttcaaaattatatttactctgaatgtaactgtataaaaatatgtgtatggacaaagactggaaagaaaaaaatagatgtggttaagtagtagaatt

SEQ ID NO: 401652 - DNA, 446 bp, Homo sapiens
ccactttttcatgggcacctggcagcagcagaggcagaaacaatctgtttgtcagtctacttaaagaaaaaaaattctgctgggatctcttctcttctctttttttttcttttctttcgccacttcatttattttatttgcaggagttgaaacatgttttaagggtgatgtttatttccccccccaaacatgaatcatttaagtaaaaccaacttaactgtagaaatgtagcaaagtaaggggaaagtagcacaaaccacccaagaggcaaaggttgtggggaagaggtgggtgcagtgagcatttaacatatgcataaatgctttacgattcacctgctcagcactgcctccccagaaggcgagcatagggaactattttacgaggatgtttccccccaaacatctgagaatgcttcaaattatagtttaaggtttaaaagacca

SEQ ID NO: 401653 - DNA, 226 bp, Homo sapiens
ggtgaactaaattaagcccttgaagttacatcctggtgatgagacagaggaaaaaaacaactatatagcagaatgacaagtgttgaaaagaaaaatagagctaggcatggaactacaggtgcctatagttccagctactcaggaggctgaggcaggaagattgcttgaacccaagagttcctgtccaggctggacaacatagtgagaccctgtcaccttgtttcta

SEQ ID NO: 401654 - DNA, 299 bp, Homo sapiens
tactatcacgtattaccaaggaggacatggaggttcagacatcaagtccagaatcaaatccagggtaccatgctgcaattggatggatggacttttaaataaatgataccaagaaaactgggaagccatttggaaaaatatgaaattagatccctacataagaaggaactccaagaggattagggatcaaaatgtaaaaactaaaaccatacaaagactagaagaaaaacatgggaaattttctttttaatctcagtataggggaagtctttctaacttattcaaaatacagaaggaat

SEQ ID NO: 401655 - DNA, 188 bp, Homo sapiens
ctggctctgagtcagctacttaatgagctccctggagctgaccctgagcacagcaggaaggtgtgaacactccctcccaaaagagtgaaaaggtggagagagttttgtcacctgctgcaggctcccgctgctcccaggggtaatggcctgggcggcattcacacccccatgtagctgtgggcaggaaa

SEQ ID NO: 401656 - DNA, 334 bp, Homo sapiens
catattttttcccacgatataagtacagtctcaaccttttatttggcaccataaagagcacataaagatctacccaaaactgtactttaaagcactggtatggaataattgtattatgtgtgatcattggtgtttataagatttgggtgtgtattcgtgtgtgaaacattcatattttgttactttcctgtggctggaagggatcttataggacactgtctttcatctttgtctgtctttcatctttaataggaatttcttttccatgcctgaaggcctcattttgaacattttgtttgtttgtttttttattttttgagatacagtattgctc

SEQ ID NO: 401657 - DNA, 518 bp, Homo sapiens
gagataagaacttgtgtctgggctttgtaatgggaggtagattataggaagcagaagggaggggacaggccatgtgggacagggaaggaagaaaataaagagtatgttactgagctgagtattgtcatcagcaacgggggttcaatcctgctggagaccctctaagaaactgtggaatgcaccttggaattatctctcccgatgctgggaggctgggacatgtaatggatttccatcctctactagttgaaggtttcctctaggaatgttaactgcccccttcctgggctgcctagcacctttgataggtaggaatacttggtccctgatgtattattctctgcttttttagggcctcagccaaaacggagacacaaaatgcatcatgctaacattgttgtatgtatgtgtatgactacataatattctatcattttgttttatataatctatgaaccaacatcttatatttactgtagttctatttttattaaaacgtatatgaaaatttacatttt

SEQ ID NO: 401658 - DNA, 1947 bp, Homo sapiens
  misc_feature (1681)..(1681): n is a, c, g, or t
acatgcgaagaaaatgcccatgcatttctttaagcagaaatataagttagtgaatttgtttcttcttgataaaatggttagaatttgcttagaaattccttttatcataaaagtaaaaattatcagctttaaccttctcatttgtctcctactgcttcttttcttgttctttattctcatccatccccttctctgtctttgcctctactcttcctctattccttcataagaatctaaacaactcctttaaacatcaattcaaatgttcttcccttggatagagatcacttccatccccttcataactagctgggcctagtacctttgggttagcaattttgccagagatgttggagaaaaagggggtagcatttcctcttgaaaatccagcctgcaaggcatttacaatctcatgctggtttcgtaaggccctgctgtccctccagaatagaggcccacagcactcactaggtaccaggcatggtgaacttgcttgcccaagctctctagtaggtggcagatttacccaggtctgcctgactttagagcctattcttttaatcattgtaccttactgtctttatagacaaggtcaggctctctatgcttctgtgagataattttccctaggagtgtaaatagttactatagagacactagatgccacctgctatagccctcagaagtggcatcagactatgcctgggctttctgttttaaggacaaggaagaatgagtgtgacagtgaaaggttgtatttgtaaaggctggaagagcagaaatccccaagtgctagagaaaagaatgtggacaagtgtatggtatccaatcatagtatgttagagctgagttgggctttaaagatgatctcctctaacccctttatttgcagttgaagacgttgaggatctgagacattaagtgaattgtctgaggacacacagccagtttcttagatgcagagccaaggatgaatttttttcattcagactaagctgttttttgcagtccacctttactctacttggggttcatttctttttaagaagtctcaaagattagaaaattgagtcattttgagcaatataatgtcatattgtacaattctgctgaaagtaattttaatagcaatgccggcagatctcccaaatccatgggtttcaaaatatttccgccttttgctaagctaatatatagaatttcaaaaccatatttataccacatacaatttccaaagagctgggcaatttcctataaaaactcagctgtgcactgattgccaagttggaaaactcagggtttcctggcaacacccacttgggctctagggaatgcaagcttctcagcaaacaacctctcctgacttacgagctccatcggcagccacgacccgagtcacagcggccctttctgatgttcttgtctctgtcgcttatgtttctcaagaacctgtaatcttgccttaatccctcaccagctgaatacctcctacatgctaaactcctggaatgaaaggtccacatttctctcatgctaggagtttgggaccagaattcagatgaactcattgctagtactggttcaaaagctaatgagccctctagattcccaggtccttagtttcctcatgggtaaaatatagacaataactcctacctgttcatctttcagggcttttccnaagattttcaacatctgaaattcacaggatcatggagacgaactaaaccatcatggagactaactaaaccagatgcatctagcccctcatgttagagttgagaaaacagaaacccagggtttggggactcccttgaagtcatcaagttcctgttgatggcaaaatcaggaccaagcttctgatcctcccaaatattccttcacttctcagtgctgcctgtgatgagaaagatcaaagcatgcatacaattataaatcatgacacag

SEQ ID NO: 401659 - DNA, 7524 bp, Homo sapiens
  misc_feature (1681)..(1681): n is a, c, g, or t
acatgcgaagaaaatgcccatgcatttctttaagcagaaatataagttagtgaatttgtttcttcttgataaaatggttagaatttgcttagaaattccttttatcataaaagtaaaaattatcagctttaaccttctcatttgtctcctactgcttcttttcttgttctttattctcatccatccccttctctgtctttgcctctactcttcctctattccttcataagaatctaaacaactcctttaaacatcaattcaaatgttcttcccttggatagagatcacttccatccccttcataactagctgggcctagtacctttgggttagcaattttgccagagatgttggagaaaaagggggtagcatttcctcttgaaaatccagcctgcaaggcatttacaatctcatgctggtttcgtaaggccctgctgtccctccagaatagaggcccacagcactcactaggtaccaggcatggtgaacttgcttgcccaagctctctagtaggtggcagatttacccaggtctgcctgactttagagcctattcttttaatcattgtaccttactgtctttatagacaaggtcaggctctctatgcttctgtgagataattttccctaggagtgtaaatagttactatagagacactagatgccacctgctatagccctcagaagtggcatcagactatgcctgggctttctgttttaaggacaaggaagaatgagtgtgacagtgaaaggttgtatttgtaaaggctggaagagcagaaatccccaagtgctagagaaaagaatgtggacaagtgtatggtatccaatcatagtatgttagagctgagttgggctttaaagatgatctcctctaacccctttatttgcagttgaagacgttgaggatctgagacattaagtgaattgtctgaggacacacagccagtttcttagatgcagagccaaggatgaatttttttcattcagactaagctgttttttgcagtccacctttactctacttggggttcatttctttttaagaagtctcaaagattagaaaattgagtcattttgagcaatataatgtcatattgtacaattctgctgaaagtaattttaatagcaatgccggcagatctcccaaatccatgggtttcaaaatatttccgccttttgctaagctaatatatagaatttcaaaaccatatttataccacatacaatttccaaagagctgggcaatttcctataaaaactcagctgtgcactgattgccaagttggaaaactcagggtttcctggcaacacccacttgggctctagggaatgcaagcttctcagcaaacaacctctcctgacttacgagctccatcggcagccacgacccgagtcacagcggccctttctgatgttcttgtctctgtcgcttatgtttctcaagaacctgtaatcttgccttaatccctcaccagctgaatacctcctacatgctaaactcctggaatgaaaggtccacatttctctcatgctaggagtttgggaccagaattcagatgaactcattgctagtactggttcaaaagctaatgagccctctagattcccaggtccttagtttcctcatgggtaaaatatagacaataactcctacctgttcatctttcagggcttttccnaagattttcaacatctgaaattcacaggatcatggagacgaactaaaccatcatggagactaactaaaccagatgcatctagcccctcatgttagagttgagaaaacagaaacccagggtttggggactcccttgaagtcatcaagttcctgttgatggcaaaatcaggaccaagcttctgatcctcccaaatattccttcacttctcagtgctgccaggggcgctgtgaggcaaaccgctgccactacactggctttccgggaagcaagctcaagtcgcggagagggaagggaggtcgtgcgctcggggcggggcgcgctcccaagtcgagcgcagcggccggggcaggttgtaccgagcgtggttctggggacaccgtgcggcctcgattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgatttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaa

SEQ ID NO: 401660 - DNA, 7424 bp, Homo sapiens
  misc_feature (1681)..(1681): n is a, c, g, or t
acatgcgaagaaaatgcccatgcatttctttaagcagaaatataagttagtgaatttgtttcttcttgataaaatggttagaatttgcttagaaattccttttatcataaaagtaaaaattatcagctttaaccttctcatttgtctcctactgcttcttttcttgttctttattctcatccatccccttctctgtctttgcctctactcttcctctattccttcataagaatctaaacaactcctttaaacatcaattcaaatgttcttcccttggatagagatcacttccatccccttcataactagctgggcctagtacctttgggttagcaattttgccagagatgttggagaaaaagggggtagcatttcctcttgaaaatccagcctgcaaggcatttacaatctcatgctggtttcgtaaggccctgctgtccctccagaatagaggcccacagcactcactaggtaccaggcatggtgaacttgcttgcccaagctctctagtaggtggcagatttacccaggtctgcctgactttagagcctattcttttaatcattgtaccttactgtctttatagacaaggtcaggctctctatgcttctgtgagataattttccctaggagtgtaaatagttactatagagacactagatgccacctgctatagccctcagaagtggcatcagactatgcctgggctttctgttttaaggacaaggaagaatgagtgtgacagtgaaaggttgtatttgtaaaggctggaagagcagaaatccccaagtgctagagaaaagaatgtggacaagtgtatggtatccaatcatagtatgttagagctgagttgggctttaaagatgatctcctctaacccctttatttgcagttgaagacgttgaggatctgagacattaagtgaattgtctgaggacacacagccagtttcttagatgcagagccaaggatgaatttttttcattcagactaagctgttttttgcagtccacctttactctacttggggttcatttctttttaagaagtctcaaagattagaaaattgagtcattttgagcaatataatgtcatattgtacaattctgctgaaagtaattttaatagcaatgccggcagatctcccaaatccatgggtttcaaaatatttccgccttttgctaagctaatatatagaatttcaaaaccatatttataccacatacaatttccaaagagctgggcaatttcctataaaaactcagctgtgcactgattgccaagttggaaaactcagggtttcctggcaacacccacttgggctctagggaatgcaagcttctcagcaaacaacctctcctgacttacgagctccatcggcagccacgacccgagtcacagcggccctttctgatgttcttgtctctgtcgcttatgtttctcaagaacctgtaatcttgccttaatccctcaccagctgaatacctcctacatgctaaactcctggaatgaaaggtccacatttctctcatgctaggagtttgggaccagaattcagatgaactcattgctagtactggttcaaaagctaatgagccctctagattcccaggtccttagtttcctcatgggtaaaatatagacaataactcctacctgttcatctttcagggcttttccnaagattttcaacatctgaaattcacaggatcatggagacgaactaaaccatcatggagactaactaaaccagatgcatctagcccctcatgttagagttgagaaaacagaaacccagggtttggggactcccttgaagtcatcaagttcctgttgatggcaaaatcaggaccaagcttctgatcctcccaaatattccttcacttctcagtgctgccaggggcgctgtgaggcaaaccgctgccactacactggctttccgggaagcaagctcaagtcgcggagagggaagggaggtcgtgcgctcggggcggggcgcgctcccaagtcgagcgcagcggccggggcaggttgtaccgagcgtggttctggggacaccgtgcggcctcgattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgatttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcata

SEQ ID NO: 401661 - DNA, 4938 bp, Homo sapiens
agcggagtccccagaggctggggtaggggcgtggggcgcccgctcctgtctctgcacccctgagtgtcacgccttctcctctctgtccccagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgatttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaa

SEQ ID NO: 401662 - DNA, 4897 bp, Homo sapiens
agcggagtccccagaggctggggtaggggcgtggggcgcccgctcctgtctctgcacccctgagtgtcacgccttctcctctctgtccccagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgatttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaa

SEQ ID NO: 401663 - DNA, 1285 bp, Homo sapiens
ctcactcatgtgaaacctatcagggtgtgtagagtgtagaaattgacacacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaa

SEQ ID NO: 401664 - DNA, 1249 bp, Homo sapiens
caaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaa

SEQ ID NO: 401665 - DNA, 2879 bp, Homo sapiens
  misc_feature (1681)..(1681): n is a, c, g, or t
acatgcgaagaaaatgcccatgcatttctttaagcagaaatataagttagtgaatttgtttcttcttgataaaatggttagaatttgcttagaaattccttttatcataaaagtaaaaattatcagctttaaccttctcatttgtctcctactgcttcttttcttgttctttattctcatccatccccttctctgtctttgcctctactcttcctctattccttcataagaatctaaacaactcctttaaacatcaattcaaatgttcttcccttggatagagatcacttccatccccttcataactagctgggcctagtacctttgggttagcaattttgccagagatgttggagaaaaagggggtagcatttcctcttgaaaatccagcctgcaaggcatttacaatctcatgctggtttcgtaaggccctgctgtccctccagaatagaggcccacagcactcactaggtaccaggcatggtgaacttgcttgcccaagctctctagtaggtggcagatttacccaggtctgcctgactttagagcctattcttttaatcattgtaccttactgtctttatagacaaggtcaggctctctatgcttctgtgagataattttccctaggagtgtaaatagttactatagagacactagatgccacctgctatagccctcagaagtggcatcagactatgcctgggctttctgttttaaggacaaggaagaatgagtgtgacagtgaaaggttgtatttgtaaaggctggaagagcagaaatccccaagtgctagagaaaagaatgtggacaagtgtatggtatccaatcatagtatgttagagctgagttgggctttaaagatgatctcctctaacccctttatttgcagttgaagacgttgaggatctgagacattaagtgaattgtctgaggacacacagccagtttcttagatgcagagccaaggatgaatttttttcattcagactaagctgttttttgcagtccacctttactctacttggggttcatttctttttaagaagtctcaaagattagaaaattgagtcattttgagcaatataatgtcatattgtacaattctgctgaaagtaattttaatagcaatgccggcagatctcccaaatccatgggtttcaaaatatttccgccttttgctaagctaatatatagaatttcaaaaccatatttataccacatacaatttccaaagagctgggcaatttcctataaaaactcagctgtgcactgattgccaagttggaaaactcagggtttcctggcaacacccacttgggctctagggaatgcaagcttctcagcaaacaacctctcctgacttacgagctccatcggcagccacgacccgagtcacagcggccctttctgatgttcttgtctctgtcgcttatgtttctcaagaacctgtaatcttgccttaatccctcaccagctgaatacctcctacatgctaaactcctggaatgaaaggtccacatttctctcatgctaggagtttgggaccagaattcagatgaactcattgctagtactggttcaaaagctaatgagccctctagattcccaggtccttagtttcctcatgggtaaaatatagacaataactcctacctgttcatctttcagggcttttccnaagattttcaacatctgaaattcacaggatcatggagacgaactaaaccatcatggagactaactaaaccagatgcatctagcccctcatgttagagttgagaaaacagaaacccagggtttggggactcccttgaagtcatcaagttcctgttgatggcaaaatcaggaccaagcttctgatcctcccaaatattccttcacttctcagtgctgccaggggcgctgtgaggcaaaccgctgccactacactggctttccgggaagcaagctcaagtcgcggagagggaagggaggtcgtgcgctcggggcggggcgcgctcccaagtcgagcgcagcggccggggcaggttgtaccgagcgtggttctggggacaccgtgcggcctcgattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggaccaacggacccatgcatttctaaatgatgccattatacactaatgatacatatagacatattttctaaaacatgtatctatattaaaaaaccactatattaatctttattcattgtcatgaatatgaagcttagagtactgatgttttattttacgttctgctcaccagttaatacatagggatgggcccaacg

SEQ ID NO: 401666 - DNA, 729 bp, Homo sapiens
gaaattaggaagctgttttagatttttttcccagaaatattaatttagtcactgagctagatagcctatttaagaaaaagtggaattaaaataaattataatgtgctttctagatgaaataagaattttgctcacttgcttttctctctccacattaaacaccaaacaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaa

SEQ ID NO: 401667 - DNA, 7888 bp, Homo sapiens
  misc_feature (1681)..(1681): n is a, c, g, or t
acatgcgaagaaaatgcccatgcatttctttaagcagaaatataagttagtgaatttgtttcttcttgataaaatggttagaatttgcttagaaattccttttatcataaaagtaaaaattatcagctttaaccttctcatttgtctcctactgcttcttttcttgttctttattctcatccatccccttctctgtctttgcctctactcttcctctattccttcataagaatctaaacaactcctttaaacatcaattcaaatgttcttcccttggatagagatcacttccatccccttcataactagctgggcctagtacctttgggttagcaattttgccagagatgttggagaaaaagggggtagcatttcctcttgaaaatccagcctgcaaggcatttacaatctcatgctggtttcgtaaggccctgctgtccctccagaatagaggcccacagcactcactaggtaccaggcatggtgaacttgcttgcccaagctctctagtaggtggcagatttacccaggtctgcctgactttagagcctattcttttaatcattgtaccttactgtctttatagacaaggtcaggctctctatgcttctgtgagataattttccctaggagtgtaaatagttactatagagacactagatgccacctgctatagccctcagaagtggcatcagactatgcctgggctttctgttttaaggacaaggaagaatgagtgtgacagtgaaaggttgtatttgtaaaggctggaagagcagaaatccccaagtgctagagaaaagaatgtggacaagtgtatggtatccaatcatagtatgttagagctgagttgggctttaaagatgatctcctctaacccctttatttgcagttgaagacgttgaggatctgagacattaagtgaattgtctgaggacacacagccagtttcttagatgcagagccaaggatgaatttttttcattcagactaagctgttttttgcagtccacctttactctacttggggttcatttctttttaagaagtctcaaagattagaaaattgagtcattttgagcaatataatgtcatattgtacaattctgctgaaagtaattttaatagcaatgccggcagatctcccaaatccatgggtttcaaaatatttccgccttttgctaagctaatatatagaatttcaaaaccatatttataccacatacaatttccaaagagctgggcaatttcctataaaaactcagctgtgcactgattgccaagttggaaaactcagggtttcctggcaacacccacttgggctctagggaatgcaagcttctcagcaaacaacctctcctgacttacgagctccatcggcagccacgacccgagtcacagcggccctttctgatgttcttgtctctgtcgcttatgtttctcaagaacctgtaatcttgccttaatccctcaccagctgaatacctcctacatgctaaactcctggaatgaaaggtccacatttctctcatgctaggagtttgggaccagaattcagatgaactcattgctagtactggttcaaaagctaatgagccctctagattcccaggtccttagtttcctcatgggtaaaatatagacaataactcctacctgttcatctttcagggcttttccnaagattttcaacatctgaaattcacaggatcatggagacgaactaaaccatcatggagactaactaaaccagatgcatctagcccctcatgttagagttgagaaaacagaaacccagggtttggggactcccttgaagtcatcaagttcctgttgatggcaaaatcaggaccaagcttctgatcctcccaaatattccttcacttctcagtgctgccaggggcgctgtgaggcaaaccgctgccactacactggctttccgggaagcaagctcaagtcgcggagagggaagggaggtcgtgcgctcggggcggggcgcgctcccaagtcgagcgcagcggccggggcaggttgtaccgagcgtggttctggggacaccgtgcggcctcgattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgatttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaacattttatttgtccattctacatttcaggccgaggccacatgcttttttttcccgtaggttttcatcaaccaaatttctaatctctatatttttgaatttctaagaaccaacacggaggttacatttcaatcaaacaatcaagccaaatgagaattaatttgcaatgttgaaagattgaatagattgcgactttaagttgctgatcgatttctgcttcatctaaagaatgcagtacacatttttcttcctcagcctcataccagtcctttctctgagtattttcttctttcatttttttaaaggtacatgtgcctcaattagtgcaattaatgtccaataaaataagatgggtacaagtattct

SEQ ID NO: 401668 - DNA, 7470 bp, Homo sapiens
  misc_feature (1681)..(1681): n is a, c, g, or t
acatgcgaagaaaatgcccatgcatttctttaagcagaaatataagttagtgaatttgtttcttcttgataaaatggttagaatttgcttagaaattccttttatcataaaagtaaaaattatcagctttaaccttctcatttgtctcctactgcttcttttcttgttctttattctcatccatccccttctctgtctttgcctctactcttcctctattccttcataagaatctaaacaactcctttaaacatcaattcaaatgttcttcccttggatagagatcacttccatccccttcataactagctgggcctagtacctttgggttagcaattttgccagagatgttggagaaaaagggggtagcatttcctcttgaaaatccagcctgcaaggcatttacaatctcatgctggtttcgtaaggccctgctgtccctccagaatagaggcccacagcactcactaggtaccaggcatggtgaacttgcttgcccaagctctctagtaggtggcagatttacccaggtctgcctgactttagagcctattcttttaatcattgtaccttactgtctttatagacaaggtcaggctctctatgcttctgtgagataattttccctaggagtgtaaatagttactatagagacactagatgccacctgctatagccctcagaagtggcatcagactatgcctgggctttctgttttaaggacaaggaagaatgagtgtgacagtgaaaggttgtatttgtaaaggctggaagagcagaaatccccaagtgctagagaaaagaatgtggacaagtgtatggtatccaatcatagtatgttagagctgagttgggctttaaagatgatctcctctaacccctttatttgcagttgaagacgttgaggatctgagacattaagtgaattgtctgaggacacacagccagtttcttagatgcagagccaaggatgaatttttttcattcagactaagctgttttttgcagtccacctttactctacttggggttcatttctttttaagaagtctcaaagattagaaaattgagtcattttgagcaatataatgtcatattgtacaattctgctgaaagtaattttaatagcaatgccggcagatctcccaaatccatgggtttcaaaatatttccgccttttgctaagctaatatatagaatttcaaaaccatatttataccacatacaatttccaaagagctgggcaatttcctataaaaactcagctgtgcactgattgccaagttggaaaactcagggtttcctggcaacacccacttgggctctagggaatgcaagcttctcagcaaacaacctctcctgacttacgagctccatcggcagccacgacccgagtcacagcggccctttctgatgttcttgtctctgtcgcttatgtttctcaagaacctgtaatcttgccttaatccctcaccagctgaatacctcctacatgctaaactcctggaatgaaaggtccacatttctctcatgctaggagtttgggaccagaattcagatgaactcattgctagtactggttcaaaagctaatgagccctctagattcccaggtccttagtttcctcatgggtaaaatatagacaataactcctacctgttcatctttcagggcttttccnaagattttcaacatctgaaattcacaggatcatggagacgaactaaaccatcatggagactaactaaaccagatgcatctagcccctcatgttagagttgagaaaacagaaacccagggtttggggactcccttgaagtcatcaagttcctgttgatggcaaaatcaggaccaagcttctgatcctcccaaatattccttcacttctcagtgctgccaggggcgctgtgaggcaaaccgctgccactacactggctttccgggaagcaagctcaagtcgcggagagggaagggaggtcgtgcgctcggggcggggcgcgctcccaagtcgagcgcagcggccggggcaggttgtaccgagcgtggttctggggacaccgtgcggcctcgattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgatttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgcctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaa

SEQ ID NO: 401669 - DNA, 4624 bp, Homo sapiens
  misc_feature (1681)..(1681): n is a, c, g, or t
acatgcgaagaaaatgcccatgcatttctttaagcagaaatataagttagtgaatttgtttcttcttgataaaatggttagaatttgcttagaaattccttttatcataaaagtaaaaattatcagctttaaccttctcatttgtctcctactgcttcttttcttgttctttattctcatccatccccttctctgtctttgcctctactcttcctctattccttcataagaatctaaacaactcctttaaacatcaattcaaatgttcttcccttggatagagatcacttccatccccttcataactagctgggcctagtacctttgggttagcaattttgccagagatgttggagaaaaagggggtagcatttcctcttgaaaatccagcctgcaaggcatttacaatctcatgctggtttcgtaaggccctgctgtccctccagaatagaggcccacagcactcactaggtaccaggcatggtgaacttgcttgcccaagctctctagtaggtggcagatttacccaggtctgcctgactttagagcctattcttttaatcattgtaccttactgtctttatagacaaggtcaggctctctatgcttctgtgagataattttccctaggagtgtaaatagttactatagagacactagatgccacctgctatagccctcagaagtggcatcagactatgcctgggctttctgttttaaggacaaggaagaatgagtgtgacagtgaaaggttgtatttgtaaaggctggaagagcagaaatccccaagtgctagagaaaagaatgtggacaagtgtatggtatccaatcatagtatgttagagctgagttgggctttaaagatgatctcctctaacccctttatttgcagttgaagacgttgaggatctgagacattaagtgaattgtctgaggacacacagccagtttcttagatgcagagccaaggatgaatttttttcattcagactaagctgttttttgcagtccacctttactctacttggggttcatttctttttaagaagtctcaaagattagaaaattgagtcattttgagcaatataatgtcatattgtacaattctgctgaaagtaattttaatagcaatgccggcagatctcccaaatccatgggtttcaaaatatttccgccttttgctaagctaatatatagaatttcaaaaccatatttataccacatacaatttccaaagagctgggcaatttcctataaaaactcagctgtgcactgattgccaagttggaaaactcagggtttcctggcaacacccacttgggctctagggaatgcaagcttctcagcaaacaacctctcctgacttacgagctccatcggcagccacgacccgagtcacagcggccctttctgatgttcttgtctctgtcgcttatgtttctcaagaacctgtaatcttgccttaatccctcaccagctgaatacctcctacatgctaaactcctggaatgaaaggtccacatttctctcatgctaggagtttgggaccagaattcagatgaactcattgctagtactggttcaaaagctaatgagccctctagattcccaggtccttagtttcctcatgggtaaaatatagacaataactcctacctgttcatctttcagggcttttccnaagattttcaacatctgaaattcacaggatcatggagacgaactaaaccatcatggagactaactaaaccagatgcatctagcccctcatgttagagttgagaaaacagaaacccagggtttggggactcccttgaagtcatcaagttcctgttgatggcaaaatcaggaccaagcttctgatcctcccaaatattccttcacttctcagtgctgccaggggcgctgtgaggcaaaccgctgccactacactggctttccgggaagcaagctcaagtcgcggagagggaagggaggtcgtgcgctcggggcggggcgcgctcccaagtcgagcgcagcggccggggcaggttgtaccgagcgtggttctggggacaccgtgcggcctcgattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaagatgattttttgaaagttaacattaatgcctgctttttggaaagtcagaatcagaagatagtcttggaagctgtttggaaaagacagtggagatgagggcctaggtcatgactctccaggccttcactgtgccacactcacagatgacagggcttgcggtaccaaaggctctttatcttccagactacagctcctattaatg

SEQ ID NO: 401670 - DNA, 940 bp, Homo sapiens
  misc_feature (1)..(3): n is a, c, g, or t
  misc_feature (5)..(6): n is a, c, g, or t
nnnannatttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgcccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgtttttaataaggtatgagcttttactgggccataatgaaagaagaaaaactgaagtgtttgtacaaaccagttgtgcgtatttggtagcaaagcagcagaatcccataaacagtgttcaattttgacagtttatgaaaggtgcttgaaaagtttatgaaagtcaaaaagtctcaaagctcttgctgtagagctgcagactccaggcagttaagtgaccagactgaaatacatatttatataaatgtactgctgaacaaatattacatatattaaaaaacattcacaagaatttgatataaggatgggaaaatatatcagttatgaaat

SEQ ID NO: 401671 - DNA, 1716 bp, Homo sapiens
  misc_feature (1)..(3): n is a, c, g, or t
  misc_feature (5)..(6): n is a, c, g, or t
nnnannatttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgcccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgtttttaataagagttttattaatcaagataaaagaaaagacacagaagatgaagataaatcagaatcatttatgcaaaaatatgagcaaaaaatcagacattttggtatgttgagtcgatgggatgatagccagagatttttgtctgaccatccataccttgtatgtgaagaaactgctaaatatcttattttatggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgtttggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcctttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgt

SEQ ID NO: 401672 - DNA, 551 bp, Homo sapiens
gaatccagctcgttaccgaatcctggaggcacaagcctgtggctactccgggaccctggagcctccctcgggccgagggtgaggctgaggaagagagtgacttcgacgtgttccccagttctccccgctgcccgcagctgccaggcggcggcgcccaggtgagaaggggcctgcgttctgcggagggatggagtggtgctgtcgccaaacccctggaatgccgcgtctcccagaccctcttctacgcctttttctacgcccacctcactgccaggggccggggacctgggacctgacgcctgatgccatcccaccccttttatggcatcttcggagggcagacggggtggccatatattaccaacctccacctccacgcacatgttttctttcgccttggctgattcctgttcactcttggaataccttcctccatctccccttcctgacagcactcagatttggggcggctcatgctgtaacattgaccctttgtcctcttgtgagaggttttccccaagcactttattctgttaaaggctctagcatac

SEQ ID NO: 401673 - DNA, 177 bp, Homo sapiens
gtagatggcatttatgtatattgataatcctaaggtacttacaaaaaatctactggaattaataaatgaatttagttaagatcacaggtcaatttttaaaaccacattgctatatatagcaacaaaattcaaaaatgaaggaaaatatatcatttccaatagactcaaaaacataaa

SEQ ID NO: 401674 - DNA, 975 bp, Homo sapiens
gtctcaaactcctgacctaaagggatcctcccacctcagcctcccaaattgctgggatcacaggtgtgagccaccatgcccggctgagaatatgcattaagttctcagtaaatgctgatgctgctggtcccaggaccacactttgagagccactggtagagaggcagacgggagtaagagagaaagagtaggcattggctggaaacggtggctcatacctgtaatcccagcactttgggaggccaaggcgggtggatcatgaggtcaggagatccagactgtcctggccaacatggtgaaaccccgtctctacttaaatacaaaaaaaaattagccaggcatggtagtgggcgcctgtggtcccagctacttgggaggctgaggcaggagaatcgcttgaacccaggaggcagaggttgcagtgagccgagatcgtgccactgcactccacccaggcgacagagcaagactctgtctcaaaaaaaaaaaaaagaaaagaaaagaaaagcaggaattggcgagccagcagcctagagtcccgaccacacacactgacgttcggatggaggcaatgagccaccttccagaaaagggcacagagatggaaagagtattctacacagacacagagctcagcctcatccttggacccccttagggttctgtgaccccagcagggcttgctgtgctgtagtgtccagtgccagcccctgagtccacagccccacatcccttcctgaccatgcctggggtgggctagcctgagtccccgatagccatcagggctcagaacctggttggcgcagggatcttcctctcctgtggcgccctaaagccttttccagtcctcaaaccccagcctctctccacacaggacacccacactcaggcagccaactcagacttctgaccacagtccacagtagaattgtgtccatctatacagaaatatctatgttaaaaaaaaaaaaaggt

SEQ ID NO: 401675 - DNA, 346 bp, Homo sapiens
cttatagaacaatccaaactcttgggaatattaagtggagaggggtacgtgcaagacaccaacagcactagaaacagtccacatctttccatgcgtggaggagtttatgctctatgtgagttcactccatcattaattcttcaaacacaagagtgttaaaggaacaagagttaatgggtcctgtcattacacttgttcccaggatgacattcttcatcttcctcttctacaacctgttctatattcccctcatgtttatccagtgcttctgctagtctagttcacttccaaagacccatgattaccatggccctgtcaggctgtaattgctgcaatttccaattta

SEQ ID NO: 401676 - DNA, 616 bp, Homo sapiens
tctgcctcccaaagtgctgggatttcaggcatgagccaccgtgcctggctgtttctctttccatatggtttatgcttacagatccttgaggttaatatgtcactttcactgttagttcctacagaagaaaggtaattttgcaataaggttttggaggttaggaacatggttttggagtcatacagcccttgggtgtgggttcgagctccatcactaggtgactgtgcggcttttggccaaatgtttcaatgtctccaaaacttgagtgtcttagtcagttggggctgctataacaaagatgcggtggcttgtaaacaacagaaatttccttcttacagttctgtaggctgcaagtctgagatcagggtaccagcatggttgggttctgaggagggtcctttttcatgttgcggattgctgacttcttatagcttcacatgacagaaagaaggcgagagagctctcaggtactttttataaaggcatgagtggctgagtgcagtggcttatgcctgtaatctcaacacttttggaggctgaggcaggaggatcacttgatgccaggagttcatggccagcctgggtaacatagtgagaccctatctcaacaaaaact

SEQ ID NO: 401677 - DNA, 132 bp, Homo sapiens
agggctgttgggcaaattcagtcagatgatgcaggtgaagtattttgaagcctcaataactgttattatcattcttaagatgctgccagggcttagcacacagaagttgctcaataaatgggaatggttata

SEQ ID NO: 401678 - DNA, 407 bp, Homo sapiens
ggaaacacaagtttgtcctactgaaactaaaagtgctgtcactagtaatagaaaactgggaggcttgttgcaaaaatcaattattcccagtgggagtcagggcatggattctagcttgagacaaggccccaaggacgcaaatgaggactccaactcctaagggatctcaagtctgaagataattcaagtcttatcaggactaccaatctttatctgcttaaacacacacacgcacacacacacacacactctctctctctctactcaccctcacactctccaaaccattaaatggtcctagagatgggaactcaaaaacccaattaccatttatgatccacaggccgccttaccctccctgaggcttccctatactctttcaatgaatgccatttcacagaccaagg

SEQ ID NO: 401679 - DNA, 646 bp, Homo sapiens
ttttataggcagaacgttaccagagtctccttgaagaactgaaaatgaacaagatacaactgcagctttttcaactataccataatgagaaaaagattcatctcctgaacaccaagttagagcatgtgaatagggatttgagtgtcaaaagagagtctttgtctcatcatgaaaacatagttaaagccaggaaaaaggaacatggaatgctaactagacaactacaacaaacagaaaaagaattaaaatcggttgaaacccttttaaatcagaagaggcctcagtacattaaagccaaagaaaacacttctcaccaccttaagaaattagatgtggctaagaaatcaataaaggacagcgaaaaacaatgttctaaacaggaagatgatataaaagccctggagacagagctggctgatttagatgctgcatggagaagttttgaaaagcagattgaggaagaaattttacataaaaagcgagacattgaactggaagccagtcagctggatcgttataaagaacttaaggaacaagtaagaaagaaagtagctacaatgactcaacaactggaaaaactgcagtgggaacagaagacagatgaagaaagactggcatttgaaaagaggaggcatggagaagttca

SEQ ID NO: 401680 - DNA, 979 bp, Homo sapiens
tcagtggctcaatcatagatcactgcagtcttaactcagcctcccaagtagctcaaaccacaggtgcttgccaccatgcccagctaatttttaaaaattgtttttgatagagacggagtctttctgtgttgcccaggccagtctcaaactcctgggcctgagcagtcctcccaccttggcctcccaatgtactgggattacaggtgtgagccaccatgcccacgctaaaaattctttttaaagtgctttgtttcattctttcgaaggctcatctgaaagaaactagctgttgttaaaggataaaatagaagaatatgtagaagaagagaaagtagtaaccagaggggaacattgtatgagatcttagagtaactgagctggaagggacctcaagaaagtcctcttccattaagtgggtaaatatactaaatcatttaatcttttaattaagttttgttaagtgtcagtattattatgtgccaaatactggtaatacaaattaaatataattcagtctattggagtagacatataaatgactacaacaatattaatataacagaggtacggagaagggcctctgagcatataatgacacagattaactctgagtagagaggtcagagaagagtacagttgagcagaatccagtgggatgagttcaccaggtggctaagggaggacataacatttcaggccagccgattatcacacccaaagacaggttaaagagcatggtcctttaatttggaaagtggaagatcaggattctgttgtgtccagatgtggctggagagggacagactattatactgtattgaggagtttggattttagtttgaagacagcagggagccattgaaggatttcaaattgggcagaaatgtcagatttgtagctccatcactctactatactgtgggtaatagattgaagaagacaggaatggaggtggggacacatgtatttgagaaatgat

SEQ ID NO: 401681 - DNA, 673 bp, Homo sapiens
tgcacacaggagccggggcttcagcctctttttctgtttctttttttgagatggagtcttgctctgttgcccaggctgaagtgcagtggcgcgaccttggctcactgcaacctctgcctctcaggctcaaatgattctcttgcctcagcctcctgattagctgggactacaggaatgtgccaccacacccagctaatttttgtatttttagtagagacggggtttcaccatgttggccaggctggtctcgaactcctgacctcaagtgatctgcctgcctcagcctcccaaagtgctgggattatatttgtgagccaccacacctgtccctctttgctcagttttctgtaagcccagctctgctccctgggacaacttcctggcagggtccttggctgtaatcctcttcaggtttcttcctgggtgataggcaagaaggaaggagcaaaaggttttgaggaaaggagaactgcgctattcctagagtcaatgatacctcagaacctttattctgcacacttggacgctatttccagtttacaaagtgttttcatcagtattttctgtaaatcccaatgactttcacaagcagtccttgtttggtgcacatacaccgaaaccgcacgacttgcgccgcatagcacctgccctgcgctcatctccacagtcggcc

SEQ ID NO: 401682 - DNA, 287 bp, Homo sapiens
caccacatctagctaattttttgtagttttggtagaaacaagatttcaccatgttgcccaggctggttttgaacccctgagctcaagcaatccacccaccttggcctcccagagtgctgggattacaggcgtgagccaccgtgcctgaccaacttcagtttttttagacttgaaagaacctcgttcacctgccacatgctatcctagggaattaatagcttcccatgtggacactcactctatgtcccgctctgccctaagcctatttatttatttgtttatttata

SEQ ID NO: 401683 - DNA, 519 bp, Homo sapiens
agcctcattcaggaggtccgctaaaaagacagaagcttgtttcctgcttgcagctttcaagacactgcatctctgtggtagggagatttgtcaggctgatgccaagaatgtctgccagtgttatggagaaaagaatggagtccgttacttaccagaaattgtgactttttgaaaatgtcttccactcccataaaagaacacaagaaccgtggtgcctcaaacattccccagaagctcctataataagatgaatttgacaatttaacaggaaattgcctccaaatattaaaccattctaatttcacccttaacactcaactaaaatgcattcagaaacgtttcgtgtataatatgcatggcacataaagcatgaaccactcaattgaattcaaatttagttgacatccttatacttttgtttttaaaaatcaacagccagaagtctacactttaagggacttccaaagttacttgcttgtgttcctcttcaataaaatgtctgtgaaattcaacattatg

SEQ ID NO: 401684 - DNA, 348 bp, Homo sapiens
tgataatttgagtcttttttaaaaaaaactacttaaaaatttttgtttacatggtcttttgctaagtattatttggatccttcaaacattgtaaaggaatactttctttatgaaaatgttgaaatcaaagcctaaaagtcttctttagggatataaacatgggtagagaattgagatggtgttaattgaaaaacacctcacagttctcaataattttttagttctccttaaataaaggtataggttcttcttgaattaaacaaactgatcagtgattagtatacaattttcaaatgaataaactgaactaaactgatttttgttttatctctgtattggtaaaaggtt

SEQ ID NO: 401685 - DNA, 415 bp, Homo sapiens
tcgttctagaggctcccccaactatggtcctcagctactccggaggctgaggcaggagagttgcttgaacctgggaggcggagattgcagtgagctgagattgccccactgcactccagcgtgggcaacagactgagactctgcctcaaaaaaaaaaaaaaaatttagaaaatcaagttttagctccgctgggaacctttgtgtaaagtgccccagacaagatttgcaccaaaggctttctgtcctcagcggttcttgagcagctatttgaaacatgctctccttttccctgaagaaatcctcagggctgggcctggtggctcacacctgtaaagtgccccagacaagatttgcactgagggctttctgcctctgaggacagcctttctactgctcctcagctgcacctccccac

SEQ ID NO: 401686 - DNA, 381 bp, Homo sapiens
gtgtctcggcatgtcctcaggcctcgtgggggggctcccttgtcctggtctcatgcagaggaaggacgtggtgtgttcagagtcagcttagtggtggcacatagtgactgcccacccagtggaagctgctacctttgcctctttggaccatcgatcctctgttcaggacctcacttcctggaaactttttttattttttgagatggagtcttgctctgttgccaggctggagtacagtggcacgatcttggctcactgcaacctctgcctcctgggttcaagtgattctcctgcctcaggttcccgagtagctggaactacaggcgcgtgccatcacacctggctaatttttgtatttttagtagagacatggtttcatca

SEQ ID NO: 401687 - DNA, 209 bp, Homo sapiens
aattctgtctataaagtagtttaatatccatactgaagagaaaccaaaaagacttctgccaaaatgcttgccatctccttgtaaagagctattactattctggggacataaaccatctgggcacgacaatttgtgaagtgtttcagttcgttttgtagtgttcttgccacctactttacaaaagaatgttactgccaataataataaaa

SEQ ID NO: 401688 - DNA, 428 bp, Homo sapiens
ctgccaggttaaaaggtcggggttgagatgcctattgctgtctttattgcaagaacttctctatctcagtgcttcaaagtaattgattcatatgaaaaattcctttcccttatatttagggtgtataatcctcaaacatcattagagactcacataaacttccttgtttcactcatcatctatggtgcctgcctgttttaaagtcatcaatccttatgttccctgatccttaagtttgtcatttctagggtgtggaaaaggaactaagaggataatgaagaatctttgcaccagtatctcagaaagaatgctcagtgtcatgacataactgtggcaacaataaaagcacttaatattcctggaatcaacttggtctaaaggtttttccaggcagacctgaaagtcctaatctagagcaaagttcattt

SEQ ID NO: 401689 - DNA, 515 bp, Homo sapiens
catccaaccctcttgcccttactgggtcagcagaagccagttctttggtctgacctaaacaaaggaaattatattaatattaaaatggttgtcttaccttgggggatctttctcctgcatggacactgagaagtcttgctccctgccaccaggatcccaggcagtccaccccgtgccttgaggacttttccacattttatacctacacgaaatactattcttaaccaaaactcatttttaaaatgttattaaatagcttattctgaaataatttcagacttacagaaaaactgtcaggacagtataaacagcttaatcccttcaccccagtcattagcatgttgccccatctgcactccctgtctctccccatgttatacacatgcacatgcacacattgtcattaacctctttctaatccttttaacaatctcataattttaaagacttttaacaacacctgaagctttaaaatgcataaagccctttctccttcacaatcgcctctggtgccc

SEQ ID NO: 401690 - DNA, 328 bp, Homo sapiens
tacacaagttttcagattgaaggagcccaccaagcacccagtagaatgaatgaaaattgacctacacccaaggcaaatcatgaaatttcaggatactgggagaaaaaagattatacaagcctccaaagtcaggggaaacaagttagttacaaaaacatcagtcactaccagaagagttttcaacttcttaatagcatcaatgaaccaaaagatgatgaggtaataccttcaggtttttaagggaaaattatttccaatccagaatctatactcaggcaatccaatataaagatagaagacatatttcagacatgaaaagtcacaacaa

SEQ ID NO: 401691 - DNA, 307 bp, Homo sapiens
ggggaatggtggtacgcaaagcaaggattggttggatgctactgagatggctgtgaggatgctggagaacagtgtgtggggcttgacagtcagcagttaatctttcaggaaacggttttctgacacagtgtaggctgaagccagactcgggaagtttggggacatatggtaggtgcagactttgtaaaatagtttggaagtaaagagggggagaagtggattggtggctccaggccaaatggagttgaaagaaaaatggttttaggacaaacatctgaagagtggaaaaaaatctgagagaaaggat

SEQ ID NO: 401692 - DNA, 648 bp, Homo sapiens
ttacagtcgaaggtggtcatctgttgtcagcaggggagggggtcaccaggtgcatggtgggagaccatgagacccattgtccagaagaagaatgtcataaggtcgattgatcagttagggtagggcaggaacaagtcctaatggtggaatgtcttaaggttggttaatcagttaagggagaaactggctgtttcacttcttttgtgtttttttggctgctccagacttcttggctgctgcaggccatctggatgtatatgtgcagttcacaggggtcacaatggcttagctccggctcagaggcctgacactgacctcagatgatccacctgcctcggcctcccaaaatgctgggattacaggcgtgagccactgtgcctgcctgggatcatatgttacacgcatgtttgttcaataagcatggagtgcagccacccacatgaatattcatagctcctcctatagcctgttgaatatgtatgtttagccaaccccttcagcataaagctcctgccccaacccctcctgcttctaaatgtctgtctctggtgtttcccagaggctgctcttcccaggctgcgggatggctaccttgctgcctgtcacccttaacaagaaataaaatctcctttccaaatttatacattg

SEQ ID NO: 401693 - DNA, 1093 bp, Homo sapiens
agacatcactcctgggggtgccctatggtacactggctgctccccagggacctgggaatgctgaatctagccattagggaaattgatttgagatgtttgcatgtgaagcttccctaagcagcactgccaaagctttggaattgtcacccaaggcttcctagactccctagctagctcgagttcgaattgccaatagtccccatggtgccaaattttgggatggttttacagtcttttagaaatgaagacaggaatggccatgtgcttctgagaccccagcacgatgccaggcccaggtctccattaatgcagtgctctgctgctgctccactggcaatttgtactcttaacataggttgggggagggacagctagggaaattttttttaattaattgtatctaaaattctttcatcataggaataaacaacacatatagaaagctccaaagctgttcccaagacctgtattatttattttatatgaccaacttgccccaaggcaattaactctgaattgctgttctaatgtgacatatctgtgtacatatgtacatagtactggtaaccagtggctgcattttattccttgctgtggactgaggtattggcttcttgaatcttgtatatgtcataagaatattatacagagagtgttatagtgaaggatgtaagctggataatttaaaacagaccttatttcatacaagtgtaattattacatcattttgggtaaatggcaaacaggattgcatgagagtgatggcatcatcatttcaattgaatctgaagtgattctaggaaattgattccactgttggattctaggaaattgagtccactgttttcctttgcgtttaatttcctttgtgtttaatttgaccacagaaacttttttgagtagcacctagtaacattgcaaggaacttgtgtatcaaggtgtatcttgattatcctgattttttttgttctctaagttgttgccagatctctcttgcaactgtgtcaatgaaaggtctgtgtttagaaaaggcagcatatcattgtatatttgaaactataggaatatatactttgtataaaacttttccaat

SEQ ID NO: 401694 - DNA, 298 bp, Homo sapiens
cttacatgacctctgatagtcctttgactagtcgggactgtgctatactcttcattgatctgggtgggactctggagaactggctgccacattcttgttatatttcattttcctgagggacaaattgttacttagtataaatcagtatcattatataagccagaaagatgaagaaagtcaaccgctagacttaccctctgagacacacaagtacagaagggaaattgtcaatttgttgggctgaggaaatattttgggactctttcagagagacagttgcttgtggtggatagataaa

SEQ ID NO: 401695 - DNA, 456 bp, Homo sapiens
tatgtgactgtatttctgaggtagaacaaatagacatgtaatagggagtggtgtagataagttcctttttgaaggctgcttgtaagtaaggattttgatgtacctgatcccaacttttcagtgtcacatatgaatttctttacaatccggttcctcctgccctctgagcttcatcacctccaaacattcataaacccaaccatgttgcattcctctgggctcctcaatcatgccgtgtgctttctctctcccaccttttgtctgtgcttcctttgtacatcactgctcttttttttttttctttttctttgccaagttgtgatggaatatacatgactactcttgctttcttctttcttcttcctgtatttattctacaactctgacttccctggaagaattaggtgttactttccctgtgttttgtgacactttgcgtgtactacttcttttttt

SEQ ID NO: 401696 - DNA, 1650 bp, Homo sapiens
cggaagtgtcgccggcctcctcccggcgcagcctccgggcctcccgtgcaatcactacgccctggggcccggaaaccgttttccggtctttcgctttcggctggggcgtggaggccgcggtgctgcgtaggccgggccgggcgcaggaacagccccgtggcgccctctctggccgccgcccgggcgggaaacgttgttccggggaccgggcgaccccgcagcggggagcgcgccaggtccgcgcggggaagtgggcggtgtgcggccggcaccgcctcgcaccacgcccccgcgggcccgcactttcccggagtgcaccccgcggccgccagccggggcgatggcggggctctggctggggctcgtgtggcagaagctgctgctgtggggcgcggcgagtgccgtttccctggccggcgccagtctggtcctgagcctgctgcagagggtggcgagctacgcgcggaaatggcagcagatgcggcccatccccacggtggcccgcgcctacccactggtgggccacgcgctgctgatgaagccggacgggcgagcacaggatgcggtatttccaaacccctgccctcggtcttttcccacctcaccgctgctcagctctcaaagccctgccgtttcctcctgccttggcttgggaagccttaggaacagaagctccctgggagcacagagcggttttaaactggccaacaccttaacgcccagagccgccctcctctcgctgccactttggaaaataagagactagagattcactggacgcttcctcccggcatcacaagacttgactgctgcttcagttcccgcttgaccttcatactttagccctttaaaggatgttacataataacaattaagagacggcagggccttcaggcagacttctttggagggtgtcaaacgccttgtttattaaagagtgaattttttaattaaaatcatgttttaaaacagagatggacattttattgatggaaaaaaatcacgttaagttagaaagctctcaaaagtacctggtatttacaactccctgtcagggagggcgaactcgatctcagagttttattttcatcagggattacgttgaggtacccagaaatgagaagatttgcccaaaatggcatattttaaaattggcccagaccagaacccagtttcctctgggattatttgttagtaatcgttttacaggctgagcattaactaactccaaagcttgaaggactttttctcattttcacttgttttctctaataaaaataatgctgtaatttcaacttcacaagatgaggcctcatggaagagtgtttaccaaaatattaaaaatactttgacagaaaaaaatcaagcgaactctttgccaaccaaatatcatcatgactgatgtaacaagtaatccaacacagatatgaaaatcacactggtaaaaatcatctcagttaattctaaaagcagagctaaccaccccttttgtcctaaggctttatggtattaaaaaataaactgtacaaaaatatagattttcccctatcccctacccctggaaagtaatatactgaagtctcatcatactgttttggggattccagtaattaaaatctctagtgaataaagacctgtttcaaaacaacc

SEQ ID NO: 401697 - DNA, 340 bp, Homo sapiens
cttaaaaagaggccgatttcatctcaaaccctggtgcagaggtcctaggcagagtgggaaacttgccctggagaagcagaagcagagaccaaatggctatctagtaaggatgttttataatgaatccttcattcctttaaagagcccattattttctgaggcttcatgggatgcgtaatagcccatgccttcactgctaagcataaaacatggagctcttagtagcctctaagacaatcatcgtcattcccacgattgccttcatcaaggccaggtactaaagaagtgctcaagaaatacacatttctgatacaacagctgatgtatttttatcccattt

SEQ ID NO: 401698 - DNA, 525 bp, Homo sapiens
cttaaaaagaggccgatttcatctcaaaccctggtgcagaggtcctaggcagagtgggaaacttgccctggagaagcagaagcagagaccaaatggctatctagtaaggatgttttataatgaatccttcattcctttaaagagcccattattttctgaggcttcatgggatgcgtaatagcccatgccttcactgctaagcataaaacatggagctcttagtagcctctaagacaatcatcgtcattcccacgattgccttcatcaaggccaggtactaaagaagtgctcaagaaatacacatttctgatacaacagctgatgtatttttatcccatttatagaatgagtgagatgatatttcgaagaataaagatgccctggctttggcttgatctctggtaccttatgtttaaagaaggatgggaacacaaaaagagccttcagatcctacatacttttaccaacagtgtaagtccctgacttttacaattgtggtaaaatagacataacataaaatttccc

SEQ ID NO: 401699 - DNA, 405 bp, Homo sapiens
aagtatgtttttctcttcctaaggtaattttaactagttcaaagcaaattgacaaatcctctatgtacaagtttttagaaccatggcttggcctaggacttcttacaaggtatgccagtgtacctttgtaaagctgtctatagaaatggttacttctacgtgcaacttgttatttcaagaattaacacagggtagctttttctgtagcaggactgttctctcagaaaggaggagaaaggctggaaaggaaggtccagctggcagctggcctttgcccgtcaagaggccaagagtccaggtgaacagttatcttcagctgtggtattcaatagcgactgtcgccagtgttcaggaagactcaggaggtcctgatggacgggagtggacgggatggaggacacagta

SEQ ID NO: 401700 - DNA, 1864 bp, Homo sapiens
cggaagtgtcgccggcctcctcccggcgcagcctccgggcctcccgtgcaatcactacgccctggggcccggaaaccgttttccggtctttcgctttcggctggggcgtggaggccgcggtgctgcgtaggccgggccgggcgcaggaacagccccgtggcgccctctctggccgccgcccgggcgggaaacgttgttccggggaccgggcgaccccgcagcggggagcgcgccaggtccgcgcggggaagtgggcggtgtgcggccggcaccgcctcgcaccacgcccccgcgggcccgcactttcccggagtgcaccccgcggccgccagccggggcgatggcggggctctggctggggctcgtgtggcagaagctgctgctgtggggcgcggcgagtgccgtttccctggccggcgccagtctggtcctgagcctgctgcagagggtggcgagctacgcgcggaaatggcagcagatgcggcccatccccacggtggcccgcgcctacccactggtgggccacgcgctgctgatgaagccggacgggcgaggtaagggccggcgctcctcctggagcgcaacggggtccgcagccccgttcccaccctccgatcagccaggaacccgctgcttgtggcgctggccgcaggagagaggagcctgtcaccctgtggagaatgcactcccagttctagtcgttgccccttggcacccgccgacactgctagtgccccatcccaaagtgagcattttctttgtgtgtagcacaggatgcggtatttccaaacccctgccctcggtcttttcccacctcaccgctgctcagctctcaaagccctgccgtttcctcctgccttggcttgggaagccttaggaacagaagctccctgggagcacagagcggttttaaactggccaacaccttaacgcccagagccgccctcctctcgctgccactttggaaaataagagactagagattcactggacgcttcctcccggcatcacaagacttgactgctgcttcagttcccgcttgaccttcatactttagccctttaaaggatgttacataataacaattaagagacggcagggccttcaggcagacttctttggagggtgtcaaacgccttgtttattaaagagtgaattttttaattaaaatcatgttttaaaacagagatggacattttattgatggaaaaaaatcacgttaagttagaaagctctcaaaagtacctggtatttacaactccctgtcagggagggcgaactcgatctcagagttttattttcatcagggattacgttgaggtacccagaaatgagaagatttgcccaaaatggcatattttaaaattggcccagaccagaacccagtttcctctgggattatttgttagtaatcgttttacaggctgagcattaactaactccaaagcttgaaggactttttctcattttcacttgttttctctaataaaaataatgctgtaatttcaacttcacaagatgaggcctcatggaagagtgtttaccaaaatattaaaaatactttgacagaaaaaaatcaagcgaactctttgccaaccaaatatcatcatgactgatgtaacaagtaatccaacacagatatgaaaatcacactggtaaaaatcatctcagttaattctaaaagcagagctaaccaccccttttgtcctaaggctttatggtattaaaaaataaactgtacaaaaatatagattttcccctatcccctacccctggaaagtaatatactgaagtctcatcatactgttttggggattccagtaattaaaatctctagtgaataaagacctgtttcaaaacaacc

SEQ ID NO: 401701 - DNA, 1382 bp, Homo sapiens
cggaagtgtcgccggcctcctcccggcgcagcctccgggcctcccgtgcaatcactacgccctggggcccggaaaccgttttccggtctttcgctttcggctggggcgtggaggccgcggtgctgcgtaggccgggccgggcgcaggaacagccccgtggcgccctctctggccgccgcccgggcgggaaacgttgttccggggaccgggcgaccccgcagcggggagcgcgccaggtccgcgcggggaagtgggcggtgtgcggccggcaccgcctcgcaccacgcccccgcgggcccgcactttcccggagtgcaccccgcggccgccagccggggcgatggcggggctctggctggggctcgtgtggcagaagctgctgctgtggggcgcggcgagtgccgtttccctggccggcgccagtctggtcctgagcctgctgcagagggtggcgagctacgcgcggaaatggcagcagatgcggcccatccccacggtggcccgcgcctacccactggtgggccacgcgctgctgatgaagccggacgggcgagaattttttcagcagatcattgagtacacagaggaataccgccacatgccgctgctgaagctctgggtcgggccagtgcccatggtggccctttataatgcagaaaatgtggaggtaattttaactagttcaaagcaaattgacaaatcctctatgtacaagtttttagaaccatggcttggcctaggacttcttacaagtactggaaacaaatggcgctccaggagaaagatgttaacacccactttccattttaccattctggaagatttcttagatatcatgaatgaacaagcaaatatattggttaagaaacttgaaaaacacattaaccaagaagcatttaactgctttttttacatcactctttgtgccttagatatcatctgtgaaacagctatggggaagaatattggtgctcaaagtaatgatgattccgagtatgtccgtgcagtttatagaatgagtgagatgatatttcgaagaataaagatgccctggctttggcttgatctctggtaccttatgtttaaagaaggatgggaacacaaaaagagccttcagatcctacatacttttaccaacagtgtcatcgctgaacgggccaatgaaatgaacgccaatgaagactgtagaggtgatggcaggggctctgccccctccaaaaataaacgcagggcctttcttgacttgcttttaagtgtgactgatgacgaagggaacaggctaagtcatgaagatattcgagaagaagttgacaccttcatgtttgaggtattgtatattgttaggttcagatatcattaaacaaatttcagttattgttaga

SEQ ID NO: 401702 - DNA, 645 bp, Homo sapiens
ccataaaacagctgctgagtcctcctacagtgcacccccacttgaactcctggattttctggggtgccatgggaggcaagattgcccttaatacaaccacactaaaaaggagacagatctctatagctatctgctagtccttccaggttccacaggagatgggaatgccaaccctggttactagctggtcttatttttaatgtagaaaaaaaaaatttatttttcggtctttggctataagggagggatacgtgagtgctgtatgtgaatgcatgtgtgtgtgcacaggagggaagtgtttataggggatttagtcttatggaatcaaataggagaaggtcccaagcattagacctgccgaatctatccatgtgttctcattaatgctctgattagcatccaaagtgttaaacaagcagctcacatgggcaggacttcattttagttttagagtttagcccaagaggagggctttcctggaatgttctagagtggcacatttacaactcactacagaggacgccactggagggctggaaaggcaggtcatcgcggaggtgaatccaggctctccaagtgattaactgtgagtctatggtttgtcacatcgagctgttgtgtattagtgggtccacctgtaaaatg

SEQ ID NO: 401703 - DNA, 327 bp, Homo sapiens
tctcaggccactgagattttcagacacaaaccaagaggattgaaaagatctcattttaggggaaaaaaaaactaaagaggggatttcaaaggcatataccctgttctttattacagtgggaagtcccatggaccgaattcaattgtcctatgaagcggaactttcgtcctaaaaatcagaagtagctggtgttggactcaacatgatcccaaactcacctaatagctgcctctgagaatgcaattttcagtcaggagcacaagagaagtgctcattaaaagtgctcatggaacttcattaaaagttccatgtttggccaaaacccca

SEQ ID NO: 401704 - DNA, 187 bp, Homo sapiens
aagttatggaggaaagtcccaagaagaaggtggccaatgccactatatctaacaacagccaccataacagctctagtctgagaggtgcttaaccccaggcacaggatgtacaaggccaggtgtgcacccctcttaggcaaggtccccaggctataggtctcttggaagcctggaagcacaggaggat

SEQ ID NO: 401705 - DNA, 258 bp, Homo sapiens
tgggttcctgccattctcctgcctcagcctccggagtagctgggactacaggtgcccaccaccatgcccggctaattttttgtatttttagtagagacggggtttcaccgtgttagccaggatggtcttgatctcctgaccttgtgatctgcctgtctcagcctcccaaagtgctgggattacaggcgtgagccactgcgcctggccgaaaaaagaaaatttaaatttccttaaagaacgagcaaatcctcatcacat

SEQ ID NO: 401706 - DNA, 252 bp, Homo sapiens
tcaacccgagagcctctggccttctcataacctacaactccattctcccagaatactccatgtgaatggggccccctagagttgtgcagcaagaaggcttgctaagtgcatccttgcacacgccttctcccagcctggcccagtctcttataaagaaccatgggcctctgcttcatcgtgttccttggacctactgttccaaagagaatcaaagactttgatcctcaaggaaagccctgtgcattctcttcg

SEQ ID NO: 401707 - DNA, 1517 bp, Homo sapiens
ttttattttacatttataccactttgagttaattatagtacaaggtgtgaggtataggttgaggatccttttttttgcatgtggatggtcaattgttctggcaccacttgatgaaaatgctatcttttttctattcaactgattttgcacctttgtcaaaaatcaatggaccatatttgtgtggatctacttctgtgtgcttccctgtgtgttaacttttctcttgctctgtctccttttgtcttcctgtccctacttgtgtttttttttcagttttctattacttttctgattctctccctccttctcctgattttcccttcccccattcccttcctcaaaatgaagcatttagattgcattgttttatatatcatacttatttttagtttaaaaagcagatgtgaagcatttgtgtttttctttacaagtacaatatgctggaaacaaattaacttttaaattataatccctttttttttttttgagacggagtctcgctctgttgcccaggctggagtgcagtggtgtgatctcggctcatgccattctcctgcctcagcctcccaagtagctgggactacaggcgcccaccaccacgcccagctaattttttgtatttttagtagagatggggtttcaccgtgttaggcaggatagtctcgatctcctgacctcgtgatctggcctgccttggcctcccaaagggctgggatcacaggcggtgagccattggtgcctgaccaatttataacccttaattaatttttctcagtgaattagtgaccttaacgaaagatggcaatctctcttcccaaactgtgtgtttcagaacttctgcaaaaggcatcacttctccagtgttacagtttctttaaaaaagaaattagtggctggacatggtggctcatgcctctaattccagcacattgtgaagctgaggtgggaggatagctttaacccaggagttcgagaccggctgggcaatgtggcgagaccccatctctacagaaaatagaaaaattagctgggtgtggtggtggcatgcgcctgtggtcttagctacttgggaggctgaggcaggaggattgtttgagcccaggaggttgaggctgcagtcagctgtgttcacaccactgcacttgcacttcagcctgggtgacagagtgagacactttaaaaaaataaaaagaaattaaggtaatttcaaattggcatgcaaaggaagtcaagatttattccttttttaccatgtcaaacattatttcattcccaaattataaaatattgctgcttttcctagagggagcagtcatgattactactggatccacagatacaaaaaaaaaggaaaaaacaattttgaaagcagcttaatgttgtgccttctctaaagccagcttttgacctatttatttttaatacttaaaaaatgtaagaaaggaattggatttttgcatttaaataaaaataaaagacactagatagtatagataataggaacaaataaaacaagc

SEQ ID NO: 401708 - DNA, 1269 bp, Homo sapiens
ttttattttacatttataccactttgagttaattatagtacaaggtgtgaggtataggttgaggatccttttttttgcatgtggatggtcaattgttctggcaccacttgatgaaaatgctatcttttttctattcaactgattttgcacctttgtcaaaaatcaatggaccatatttgtgtggatctacttctgtgtgcttccctgtgtgttaacttttctcttgctctgtctccttttgtcttcctgtccctacttgtgtttttttttcagttttctattacttttctgattctctccctccttctcctgattttcccttcccccattcccttcctcaaaatgaagcatttagattgcattgttttatatatcatacttatttttagtttaaaaagcagatgtgaagcatttgtgtttttctttacaagtacaatatgctggaaacaaattaacttttaaattataatccctttttttttttttgagacggagtctcgctctgttgcccaggctggagtgcagtggtgtgatctcggctcatgccattctcctgcctcagcctcccaagtagctgggactacaggcgcccaccaccacgcccagctaattttttgtatttttagtagagatggggtttcaccgtgttaggcaggatagtctcgatctcctgacctcgtgatctggcctgccttggcctcccaaagggctgggatcacaggcggtgagccattggtgcctgaccaatttataacccttaattaatttttctcagtgaattagtgaccttaacgaaagatggcaatctctcttcccaaactgtgtgtttcagaacttctgcaaaaggcatcacttctccagtgttacagtttctttaaaaaagaaattagtggctggacatggtggctcatgcctctaattccagcacattgtgaagctgaggtgggaggatagctttaacccaggagttcgagaccggctgggcaatgtggcgagaccccatctctacagaaaatagaaaaattagctgggtgtggtggtggcatgcgcctgtggtcttagctacttgggaggctgaggcaggaggattgtttgagcccaggaggttgaggctgcagtcagctgtgttcacaccactgcacttgcactccagcctgtatgtcatttatatctcaaaactttttaaaaggaaaatttaaatgattttttaaaagtctagtgatatgtatccatggaactagaaataaatctattacagtccctgagttt

SEQ ID NO: 401709 - DNA, 411 bp, Homo sapiens
actaacacgagccctctattttggaaccaatcctgctgacacctggtattttggacttctagttccagaactgtgagagaataaatttctgtcatttaagccacccagtttgtggttctttgttacaacagccctaggaaactaatagttgataaagccatgagactctttgttcttttatgtgtatggatttttttgattatcaaacagtacttgttcattagatttctgaaataccacagaaatactacataaagaaaattagaaatatccataattccatattagcacagaatcactgctatgcaaatatgttcttaatagtacacagtcctagccatcaaactgtaaagtaaaacttcatattaacatcttttcactaacaatatagcacctcaaagatacactgag

SEQ ID NO: 401710 - DNA, 222 bp, Homo sapiens
gccgtccttgcgtggcccgggaggcaggagcccatagcatttcgaatggcttcaatgttgggattataggcgtggcataagtcaccatgctgggacttttttatttctttaatttttaattccagatctggtcacagaaggatttgttgagtagcctcagcacttcttgctttttcatttctttctgataagttacaccatggaccttccccatttttgtcc

SEQ ID NO: 401711 - DNA, 449 bp, Homo sapiens
tagctgggattacaggtgcctgccaccacacccaggtaatttttgtacttttagtagagatggggtttcactatgttggtcaaactgatcttgaactcctaacctcgtgatccacctgccttggcctcccaaagtgctgggattacagtgtgagcctctgcttctggcctttttaaaaattttttaaatttatattttttgtagagacagggtcttgctgtgttgcacagtctggtctcaaactgctggtctcgagtgatccttctgcctggcttcccagaatgttgggattataggcgtggcataagtcaccatgctgggacttttttatttctttaatttttaattccagatctggtcacagaaggatttgttgagtagcctcagcacttcttgctttttcatttctttctgataagttacaccatggaccttccccatttttgtcc

SEQ ID NO: 401712 - DNA, 435 bp, Homo sapiens
ccttggtctcactgtctcacaaggtcaggtgaagaggaaagagtagctacctgttagaaagggtatcctctttcctttaccccttctccttgtctactttttcttccattagttcttccatttaaaactcattttcaaaagctcccaaattgctacttggcagcagatggggcactgaaaagaggaatgacaggaaaggtggagcccatctgattgacttttcctccttcattgcaactttctcagggttctctgcattacacatttcaaaaggaaagttctgggcaccatccttggtcatggtgggaatttaattgacttggactcaggtggcactggagccaactggaagccaccaagctctgttctctctccagttcctcaactaactagaaggctgatcctaaatgtaaagccctttagatctaaaaccag

SEQ ID NO: 401713 - DNA, 387 bp, Homo sapiens
attgagactgtgagagctctgtctctttttaactcctggtttgcttctctgtaggtgatggccttgtcctcaccttccagggacaacttttctccacattgaggggaagatggttgtcctcagtcactgactaacagtcttgcatctttctgacatgaaaagtaaatcctttttccttccagcacctaatcaggaattgcaggggaaattgtctgattaacctagcttgggtaggacagaaacccctggaacaggtattatgaatcagagaaattgggttctatgactggccagccttggagtgcacatccacgctaatgatacagtggcctgatttagtaaatgaaaatgcagtgtaagtatggactaaaaaatgattcattcctg

SEQ ID NO: 401714 - DNA, 374 bp, Homo sapiens
gagagtggagagaatgtggtttggccacggactggagataggggctgactttcacacagcaccctggcatggtgatgggcacttcctgtacgtggccctctgttgtcctcacaaccaccagctagattggaattcaccctatttcataaaggagcagagggccagagaggtgaagcaagttgcctaaggtcacacagcctttaattgataggctcgaacttgggtctttgcagcatttaatcccaggctccttgtgtgaggcacttggaagagtgaggtaatggagatgaggcctttttggagattttactcaggtttttagagggctcagtaacttgtcatgtgaccaaccatctggaccagggaggtcttgg

SEQ ID NO: 401715 - DNA, 261 bp, Homo sapiens
cacacacatagtcttagaatgtaaagtcacgttttaattttaggaaaagttataacctcctaccagctaataaaacaaaaatgtgaactctccagtaaagttagtatttttttggactttaataaccaattttattatatttacctaaaaggggggaaaacacaaagtgttaaataaaaagaataaattcttggctgggcatggtggctcacgtgcctgtaatcccagcactttgggaggccaaagcaggcggatcatgag

SEQ ID NO: 401716 - DNA, 197 bp, Homo sapiens
ttcagtgcttccccatttcttacaggaggaatcaaaatattttaacatggttaccattatagcaccatcccttatgattccaaaacaccatattctgcactacagccacatgaggatctttctgtttccaaaacgcattagttcacctttcccaggcggcctttgcagaagctcttgtctctgtctaaaacacaagt

SEQ ID NO: 401717 - DNA, 295 bp, Homo sapiens
gcatgtcaagccttacagagagggatatttttatctttgccctacttccatgccttagactacaccaagtataacataagacctcttagacatactataaatattggctgatatatagctagtgaaaataattgaagaaagactttgcttgttaatatacatagaaaatccattaaagaatgctgatggcctttctgtttccaaaatgcttttacaatcacatttgtgtttttttccctacaataaatctgaaccaagttggcatttatattcctattaatatttataagcaaag

SEQ ID NO: 401718 - DNA, 643 bp, Homo sapiens
ggatgttgagaatgcctggtttgcctgtgtgcctttaagcactagcccagcttggcattgtcaagatttctctctgttgtctccctgttatgcagcataacgaaagggcagttgaatggttaacttgcttgccagcctctgtttggcatgaagtgtgtgtatatacaggaatgtggaatacatcacttaaatataataatggaattaccccatgcttcgtatgtttttacatagttttaaactcataagacgtctggaatgtccccgagttgcaagtttttgagatcttttcagggtcctttctacatcaagccgaagcctgtaacgttaagacttattgtcagtaagaagttagacctacatgttttacttcagaagacccccaaaactccaaatgtcacttacgcagttttactgttgaaaagcagtcatctcccgggggtgaggtggtacagccagctggcccacagccctatgactgcagggtggggaacctttggctggaagttattaaactaagttttgcttaatgtcgtttgcatttttcatagcgaaccaaagggctttatgttactgtttcttattgaaatgatttagaaagaagcaatccattactgcgttctttaaaaacacctgcaaagaa

SEQ ID NO: 401719 - DNA, 124 bp, Homo sapiens
ggctgtgtgaggtgtcagtctgcccctactgggggtgcctcccaattaggctacttgggggttagggacccacttgaggaggtagtctgtccgttctgagatctcaaactccgtgctaggagaa

SEQ ID NO: 401720 - DNA, 673 bp, Homo sapiens
gaactccaggaagtcatccagctgccatctttgttgacttttacatatccaaatgaaaacaaaattaaatgttcttagagaatgaactttgaagtgtatatcatactgggaaataaatgaccataagtacatgttaatgttttaacataaaagttatcccacttgaatctgagtgttcttggagaaaccttaaatctcttcttacaactagtaggatttgtgtccttcctcactaaacaaatattgaatgtttattttatacaagtagtttaaacttgcctaataatgtcaataatcaagggatttgaaaaccttgacctctgaccaatggaaggaccttagttattctagtgcaactagtgtagcacgttagtagaccagcatgtaagaatatatgctgttaatgcctgttcttttgaattcctgacagaaaagtaactggctatacactgaagtgtttcagctgtaaaattagcagtaaattaatataaaacttgcagcttaaatttaatgggacaacactttacatgtttgcttggttgttttttcaaaagtaaaatttgaccttttccagcaaagaggagcttggtgcaagataggccagagttccaatccacaatctatgacttagtagttttgtgaaactggttaaacctttaaactcttgagtttg

SEQ ID NO: 401721 - DNA, 441 bp, Homo sapiens
ccatacttctgagttttcatctttcatgtggttagtcaactagagactgtatgcttcttatcctcattttttatattattttctaagattatatgtacagaccaagcaatagtccctaatttttgtttttatgaatcattgtgtgaggtgatgagtgagttactcaggagctcatttcatcaactgagataggctctgtagatggaagccttgaacttcatctggaccagctgcccacgattctcaccccttgctgtacttcagggcatccagttcacctgggaacttgaaggaagggaaaagagaagaataaacagtacacacacacacaaacacacacacacatacacacacacacaaatatatatacctacactttaccctctgagattcagattccattgtctggaagttgccagtcaactggtatttttttaaagc

SEQ ID NO: 401722 - DNA, 592 bp, Homo sapiens
atttatttatttttattatagccattctaatgggaatgaggtggtacttcattgcagtttggatttgcatttccttggtaattagtaatgtagagcatctttttgtgttccagttagccatttttgtatctctttttgacaaacatctattaagatcttttgcattttttaaattagattataagtgtattttattttgagattttaaagtttcttatatattctgaatattagccttttgtcacatgtatatgaaaacattttctgtcatcgcctaagctgtctcttcaaacttttagttgtttttttaatatgaaaaagcattttagtttgacataatgttgtttgtttattcttgattttgttgcccatgttttgaaatcttattttaataatcctttcaccgtccaatgttataaagcatttttttatgtttttctctaatagtttcataattgatggcattacatttaagtctttagttttagttgattatcatatatggcaaggtacaagggtctagtattatttttctgaatataaatatttaaatggccctgcaccatttattaaagagattagcttttctcta

SEQ ID NO: 401723 - DNA, 1058 bp, Homo sapiens
gcattgatctttttatgtactgattcacgaggacttaagcctatgatgcagttgttttcccagtcttgggagctggcagatgccattacccaggtcaggagatagaaccttgccagctataccctgaagctgttcaagtctttctcccaattacagtcttcataagagttgttagaaggactgaatgagatgaagtagaggaaagtcttctaggacaggggtcctcaacccttgggccacagactggtggcaggagggctgcacagcagatgggatgcctggttgcaagaaaacaagctcagggctcccacagattctacgtgatgcagttttcacagatttgtggccagatgctagagacaaaggctgagaagttgtccaggacgtcatattcttgctttgctggaggcagatctgaaggatgtcatctctcctgtggcttcttctagtgtggggtcccgaagcctggcttccccagccgatgtgctgctttagtcagcgtctgccctggtccttcggttcgcaggctcacacgcttttttgggttgtgtccctttggactgcagaggctacgtgtcctgtgaccaaccacgaaggcggccactcccgctcccctcaggagtgtcttaaaatacctccattttagctaccctattgaatgacaggttagctgggtgctgggttttcaggtgatggacattttccctcagtcctctgaaggtgttgctggcttcaggcattgatgccgccactctgattgttgtatgcagtgagcaaactagaattttctcttggctttctagattttcttctttatattctgaaactttattatatcaaggtttgaattttattttttttggagacagggtcctactctgtcatccaggctggagtgcaatggtgcagtcctgctcactgcagcctccaagtccagggctgaagcgatccttctgcctcagcctcctaagtagctgggatcacaggtgtgcaccactctgcctaacaaggcttgttttttgtttgtttgtttgttttaaataaatacattcagattg

SEQ ID NO: 401724 - DNA, 868 bp, Homo sapiens
gcgggtctgccgtatcatactcagaaatacttgaatggctttccccaagaacaaaaccacaggcttgcacacgagagcatctaaagcgctagtctgtgggactgacaattttcttcttctctatccatttccatagcagttttcacagatttgtggccagatgctagagacaaaggctgagaagttgtccaggacgtcatattcttgctttgctggaggcagatctgaaggatgtcatctctcctgtggcttcttctagtgtggggtcccgaagcctggcttccccagccgatgtgctgctttagtcagcgtctgccctggtccttcggttcgcaggctcacacgcttttttgggttgtgtccctttggactgcagaggctacgtgtcctgtgaccaaccacgaaggcggccactcccgctcccctcaggagtgtcttaaaatacctccattttagctaccctattgaatgacaggttagctgggtgctgggttttcaggtgatggacattttccctcagtcctctgaaggtgttgctggcttcaggcattgatgccgccactctgattgttgtatgcagtgagcaaactagaattttctcttggctttctagattttcttctttatattctgaaactttattatatcaaggtttgaattttattttttttggagacagggtcctactctgtcatccaggctggagtgcaatggtgcagtcctgctcactgcagcctccaagtccagggctgaagcgatccttctgcctcagcctcctaagtagctgggatcacaggtgtgcaccactctgcctaacaaggcttgttttttgtttgtttgtttgttttaaataaatacattcagattg

SEQ ID NO: 401725 - DNA, 329 bp, Homo sapiens
tgggaagcccttggtaaagaaagccaccattttttttacttaggtatattccagtggtttatcatcgggagagggatgataatggaggaaggctcaatgagggagaaagtattcagctgcttgatgttagagcttaatggcaggacctaccagttgcttttcacagaaatgctgtgtattgatcctaaggcagcatgtgttctcttttgtgtggccattatccattctcccacttttccatcagtgactgctttgcttttgttcctcaatcctttacccaaaaatggctgaattatttctgtgcagttaaataaagtgatccaaactca

SEQ ID NO: 401726 - DNA, 595 bp, Homo sapiens
ttaacctgtagcccagaggtgttagatttattttttgagacagagtctcactctgttgcccaggctggagtgcggtggcacaatcttggctcactgcaacctctgccccctgggttcaagcaattcttgtgccttagcctcctgagtagctgggactacaggtgcatgccaccacgcccagccaatttcttgtattcttagtatgagacagggtttcaccatgttggccaggctggtctcaaactcctgacctcaagtgatctgcccgcctcggcctcccaaagtgttggaattacaggcgtgagccaccacgcccagcctatgatattctttttataagcaacttttaaaaagttttttaaaagatctcataagcatatagcactgctacactttagatcactactgtccagtcacactttatataaggatagatgtgtccttttcactccccagtatggtagttactagtcacatgtgtagctactgagcccctgaagtgtgggtgggatgattgagctgaatttgtaattttaatcaaagttagccacatgtggcttgtggctactgtattggacagcagagctttagataa

SEQ ID NO: 401727 - DNA, 255 bp, Homo sapiens
cccaaattccttaaaatcagaatcttaaatatttataccaagttcagtattgaatgactttagaagttaagaagaaaaaaatagttgatttttaatcataaattttttaggtgatttaaatgtcttctgattgacttcattgttaagttcaaaatcaaattgtttacatcattagtcagcccttgtctgctgcttagctgatgggcaagacttagctagcaggaactcagtaaaggttggttaactgatgtttag

SEQ ID NO: 401728 - DNA, 768 bp, Homo sapiens
caagttgggccacccacacggatctggcaactctgatcgcccatatctaagaggagcacttagttctcagttgattattttcataagtggtttctttggtttgcttctctagttggaaaattatattttactttcactttcaacgctatacagtcctttaaagattcttgtaactttctgagaattttagctttctacatttaaaatgtgtagaatctagttttccaacaagcacaaatgtcaagtgtacacatgaaatacattttacacaattttttgtaacagacaagaaatctcgtcactttatttagaacatatcctttcctcaatatactgtaaagtaataatttgtagagtttaactttaatactagggaactgattttacattttgcataagtttctgagataaatgtactctacttcagagaacagtacctatatatggccaaaactacttattttctacaccactgagaaaatattggcagaattggctaggcgcggtggctcacgcctgtaatcccaacactttgggaggccgaggcgggcgaatcacgaggtcaggggatcgagaccatcctggctagtacggtgaaaccccgtctctactaaaaatacaaaaaattagctgggcgtggtggcgggcgcctgtagtcccagctactcaggaggctgaggcaggagaatggcgtgaacccgggaggagcttgcaagtgagtggagatcgtgccactgcactccagcaacagagcgagactccatctca

SEQ ID NO: 401729 - DNA, 587 bp, Homo sapiens
agcaaagggaacttgagggaacttgaggagtatttttggattgattgattacaaaatggaaattagatggaaatacagggcaacataaattccaaagtcagccgtgcctgaaatggtttcctacaagtctacaggcagactctttccctctgtctcttacaccaaaggcaaattaagccacagccgggggcatcctaacgatattggaagctggtaaaaagtatgaatgagaaagatggggaggagagcagggtgtgggactggagtggggatgttaaagctcatgttcagtaacatgtccttccccacacgctgaccagaggcaccattgcccaatgtggctcagatataccagaggcaatagcagtctgtttgctctgtaggaagtgcgagttggaagttgattttccctcagtttggaaaccaatttatgacaataatactttcagatacagacctatatggcacccttcttctgattaactcaacatgcttcatgtctgtgatttgcacttagcattttttatttatttattttttttgtcttcagatggagtcttgctctgtcacgtaggctggagtgcagt

SEQ ID NO: 401730 - DNA, 338 bp, Homo sapiens
ggaggaggagggtaactatgatcacagctttcttcaactactttaaacataaacttccctttccacacgagaggtaggtctctggcactgggatctatactgtacgtgagtactctgtgaatggtggttgttactataataggaaagtgaacattatatttgctaaatattaaaagaacactcagtaaagaatattttagcccttgaagaaatgatataaaaaagtatgtcataggctgaggcaggagaatggcgtgaacccgggaggcggagcttgcagtgagccgagatcccgccactgcactccagcctgggcgacagagcgagactccgtctca

SEQ ID NO: 401731 - DNA, 279 bp, Homo sapiens
gagatccaatcaggaggcagaaatcacacaataatttgaacttggaaagttcaacatcaaaaaaatattacaggggactggagtaatgagagattggctaaaagattatgggaatgtcaaatttaagaagcactcactatccctagggttgagataaaggtcctccccctccctccagacttaagatgcagatctcgttggagggcacagatagtggctcactgaatggcagagaagtagctgtggtgaggtgccagtggaacctgcccaaaaatcctc

SEQ ID NO: 401732 - DNA, 513 bp, Homo sapiens
tgatggtagactagggaggaaagaatgagaggattaaaaagggttgggaacagaagacacaagtgccttaagggataggaactataaaattctgaagaaaacctctaggtgtgttcctgtttcagggaatatctgcaatattacattctttgacaacagattgtccagagagagtgattattcctgagcttctgtgggacttggtgagtttggaataataggaggcaggtggaacctggaggtggggttgggggagaggcaatgagagagccagctggaatcagaaatacccagcttagggatctgcagtagccaaacacccctcgcacctacccgctgcctttgtcaccgcccccaccacctttctcgagctctagtccttgttcctctaggccctgggaactgccctttggcatgttgagcttgagatatgaatgaagataggacctcaaaatgcaagacaaactgaattttcccctggtagcgttttaatctggtagttggtttctgttg

SEQ ID NO: 401733 - DNA, 212 bp, Homo sapiens
tcttgatgagcgacgggtattacatcagataccctgaaacatttcaatatgataagtcctatagtagaagttatctgaagtttttgtaatgaagaaggactaatttgtcatgaaaataaataccatgcaatctagttttcttcattgtagttattactcaaatataactggggttttctgtggccagtctcaagggacaacatttttgccag

SEQ ID NO: 401734 - DNA, 228 bp, Homo sapiens
  misc_feature (35)..(35): n is a, c, g, or t
  misc_feature (54)..(54): n is a, c, g, or t
  misc_feature (65)..(65): n is a, c, g, or t
gattttttgggttaggtcaggagttatttttgccnccttcatcattagagttgntttttctttgnatttaggctctgaaccggcctttttttaattttagagactaggtcttgcactgttggccagctcactccagccccaaactcctgtgctcaagggatcctcttgcctcagcctccaagtagttgagattacaggtgcgtgccgtcatgcctggcccttccttta

SEQ ID NO: 401735 - DNA, 450 bp, Homo sapiens
gcaaaccagcgccgaaaagtatccggcctgccagggtcacaggagcttcttgggcaaggctgttttgatttacagcaatgtagcaagaagagtttcctgtgagagactaaattgctttccaaatctgttttgggccctgtaaaatggcgatgatgacgggtgattttggaagattgtagtgagggcaaggaagtgtctagacaaagcttgagaaaatggtaaatattataccatataaaataggtcttattgccatgggttatctgaaagctgtggaaagggccatctacaacatgaggcttggattacacagatggattcagggacctccacctctacggcatctgctaactcaccttcctcaggtgagacttacatccaccttcctcttgacttctacccaaggagcccaggaaaagccaagagaacaagggggaggaaatgccagag

SEQ ID NO: 401736 - DNA, 771 bp, Homo sapiens
tgataccaggttctccagggagacagatctgggcttctcagcagaggccgcagctgaaacgatgatgccaatggtttggattgacagcagcttaaggaggaaaaaaaaaaaaagaaagaaaaaaagaaaaggctggtgacacccccctggcgtggttgacctggtcccagtcgcagtccctatgggacagcagagctgtcaaaacagaacccaatgatgacggctgaaaatcaagccagactgctgtgcggtcagcttgccgccgtggaatgccttgtgtcttggccatgtccagccaagggtacaacgtgcttgttcccgatcacccaggtttgccattggaagtcaaagacagaatcgcttcatggcactacagatgtggaaaaataaaaatctcagctagaggtgctgagaggagggtgccccaacttcaggaggaccatgtgacggctgtggttgttttcggggtcacttgcagcacacacagcgtccccttgatgctcgatggggaccgcagacgggcctgcagacctaacccctggctgtggacaggagaggctgctccaggcttctttccttctcaatgctttacacaggatttccttcatttgtgctttcctttggtttaacagttaaaaaagaagagtgagggggcaaaatggtttgtcacttgtccaaaactgagagaagaggtggaagtgggcgccaaatctcctgggtgatgcttcctggtcctggcgatcggttgccttgctcagggtttgggagctg

SEQ ID NO: 401737 - DNA, 168 bp, Homo sapiens
ggactttaagatgagctttaatttgtttgttttccttaagtgcatttatcgatgtaaacagagcatgttagagattcccggggagagcagactattgctgatatgttggttttaattcaaaagaaacgatgatgccaatggtttggattgacagcagcttaaggagga

SEQ ID NO: 401738 - DNA, 825 bp, Homo sapiens
tgataccaggttctccagggagacagatctgggcttctcagcagaggccgcagctgaaacgatgatgccaatggtttggattgacagcagcttaaggaggaaaaaaaaaaaaagaaagaaaaaaagaaaaggctggtgacacccccctggcgtggttgacctggtcccagtcgcagtccctatgggacagcagagctgtcaaaacagaacccaatgatgacggctgaaaatcaagccagactgctgtgcggtcagcttgccgccgtggaatgccttgtgtcttggccatgtccagccaagggtacaacgtgcttgttcccgatcacccaggtttgccattggaagtcaaagacagaatcgcttcatggcactacagatgtggaaaaataaaaatctcagctagaaagaacgtccgatttggagatagcgggaggacacgaaggagtgggggccattttggtgctgagaggagggtgccccaacttcaggaggaccatgtgacggctgtggttgttttcggggtcacttgcagcacacacagcgtccccttgatgctcgatggggaccgcagacgggcctgcagacctaacccctggctgtggacaggagaggctgctccaggcttctttccttctcaatgctttacacaggatttccttcatttgtgctttcctttggtttaacagttaaaaaagaagagtgagggggcaaaatggtttgtcacttgtccaaaactgagagaagaggtggaagtgggcgccaaatctcctgggtgatgcttcctggtcctggcgatcggttgccttgctcagggtttgggagctg

SEQ ID NO: 401739 - DNA, 502 bp, Homo sapiens
tcaagtgattgtcgtgcctcagcctcccaagtagctgggattacaggtgcacgccaccacatggggctaatttttgaatttttagtagaaacagggtttcaccatgttggccaggctgttctcaaactcctgaccacaagtgctccgcttgcctcagtctcccaaagtgctgggattataggcttgaactaccacgctcttcctagtgcaagccatttaaacattgtatccaacagctaaagaaagaattcattccacaggcatttatgaaatatgagagacttgactcctgtccaggagaagcatcagcagctagctctacattattttctgatactattcctacactgtgccaccgtgtttccttagcgacttgtgaagaaaaagtgattatatgaagtgtaaatactacacttcattaatggcttggagatactgtgtatctttctgtaattttacccagttaagtgaataaaagcaacaggcccggccggtagccatt

SEQ ID NO: 401740 - DNA, 454 bp, Homo sapiens
ctcttcccgcgttcccactgagcaggtttgaggggcagcaggaaacaaggctgactgcattgtggcacccctccaggctgccttggacgagttaagatgggatccgtcagcttggtccctaaccccaggtaaagatggaacagatgctggctgtgaccaggagtcctgaatttgccttgcaccatttccctccaccggactgggagccactgcggggcaggaagctgccttttccatttcccaagaccggaatcaatcacagcggctcatcgcatcatgcatcctctgcaatggttccttcctttccagggaggttggtcacggccaatgctgtcctgtgtccaccaggtggcgctcgcgatcaccgcaaaacacatggctaccgtgatggtttttaaataagaaatcttacaatggttttagacataaaggactgttgagaatatgatagaga

SEQ ID NO: 401741 - DNA, 412 bp, Homo sapiens
ggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctgcaaaatttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgtgaattaataaaaacatttcatttcca

SEQ ID NO: 401742 - DNA, 459 bp, Homo sapiens
acaaaataaaacttagagtcctatgatttaaaacaataaacatatatttttagataggttaaatcatctgtggcatccctgcctaaagattcatggagtttaaaaatccctaacttgaagcagtggagagccttgggagtttggtgtggctagggatggggaggtgtgtggggataagaagacagcattggcaggacatgggccccactgcgcaggaggacagggtggaggtggactcttgatggttatcaggctgttatattttagttcaggggcaatgtgatgggcgggcctcgcctaaggtagccaatgggaataataaagaaaatggtgattacaggagattttttgaagggaaatgaataatacttgtttagtgactagatatggatggtgagtgggaaggcttgaaaactcatgtctctagttgactgagagaatttgaacggccagtcagac

SEQ ID NO: 401743 - DNA, 206 bp, Homo sapiens
aggagatgaaggtagtaaggaaaacatgggttagataaaggccatatgtgcctcactcaagagttagattttagttcattatagtatctactgaatgatttttccacaggatagtgaaatttttcttcattttagaaggactataatgtagacgataagccctgtccacacttttcctgtttcctgtgtctcttctggctgtctgt

SEQ ID NO: 401744 - DNA, 388 bp, Homo sapiens
taaatgtagaatttatccttgttgtgatagattgacagaatttctctcaaacctttatgagccctaaacatttctttaaaacaacacttggaaaagtatttcaaggtctttcttaatttttgatctgttgttaaaaatttccctttcttttggatcagttttggtaattgctacaattctagaatgaattgttggggagcatgcctaaaagtagacaccaataagggagttgctctaacagtttaggcaggagatggttcccaattctaaatccatagctttccctaatatcgggcttgataaataacaacacagtaccccccatttataatgccaaaaccagggaattctcctgaatttctttctttcccttagcaccatttaccac

SEQ ID NO: 401745 - DNA, 322 bp, Homo sapiens
agcaaagatttgggacctaccagtggcttgatatccacacatgaaatttccttgtttgctatgtccacagttaaggtagacatggtggctttctttaaactgcaaggcaacggaacctgtgttattagagaatagcacccctgtaaacgacacagctgcattccattcatccttcagtccattcagtcatccgtgcatccatccatccatctcatccatccttccatccattcattccacccacccatccatccattcatccatccatccacccttccatctctctacccatccactcatccatctacgcatttatccatcc

SEQ ID NO: 401746 - DNA, 318 bp, Homo sapiens
agcccagatgacgcccatggatcaccaccatgaggaagcaaggaacaagatttaaattaagatttaacatattaacctttaacaagttaaagtttaacatgcccagccttacttcttatactataatatatagtttgaagtaagtgaccacactagttgctttaaaaatatatttgcaatctggccaggcgtggtggctcatgcctgtaatcctagcactttgggaggccgaggcgggtggatctcctgagctcaggagttcaagaccagcctgggcaacatggtgaaaccccgtctcaactaaaaataaaaataaaa

SEQ ID NO: 401747 - DNA, 516 bp, Homo sapiens
tctaatataatgcctattttgtaataaggtattgaatattttgtgtaatttagtgaatactgtgctgcaagcgaaaaacagaatggttgtagtctactaaatgtatattgctttcacaccattgtaaagtaaaaaaatcataagttgaaaaaaaaaaaaaaaaaaaaaaaaaaaaggggggggggttaaaattttcccttggggggccaatttggggtacccggttttttggtacacgagggggtcccttattagggagaggtcgtattaataagcgcttagggcattggcgccggtcgttttaacacgtgtcgtggccttgggagaaacatgtgctacgctttgggacgtctcttgggggaagggacccttaccttttggtgggtggtcgaccttattggggacacactttccctaaacggagattaagaggctcaagcgaacatttcaaagttttaagggtgtttatgtgtcgtcaccctaagggaatatcgtggggttagaaactttgcgtta

SEQ ID NO: 401748 - DNA, 382 bp, Homo sapiens
tattgctttttgatgaggcgtattttattcaatgatcttgaccgctcttcccttttctcctaggtagctcccacacatcctttggatctctgataaagagtcatatacttaaagagccatcctcacattcctgcccaggtataccccaaataaaagttatcatagcactgtgcattcctcctttgtaacacttgccaccattgaaattttatttgcttgtgtgattattttgtctaccttctctcctctagactgtgagctgcatgagagaggccatgtctcattttgttccattacatctccagcacttaagagtgctggacacataacgagtgtctgacacataacgagtgctgaataaatgtttgttaactgataaaat

SEQ ID NO: 401749 - DNA, 424 bp, Homo sapiens
ggatccagggcctctcagagttcacctgagctttcccaagtctggtttgttctctctaccctgctgctactactgcaagtgactttcacaagatgcttctgagcatagcattgctctgctgtgaccactgcagatgtcaagagaatttctgccttttggaacttggacaatattggccacctacccagagagaggagaaggataatccagacataaaggtagctcccacacatcctttggatctctgataaagagtcatatacttaaagagccatcctcacattcctgcccagactgtgagctgcatgagagaggccatgtctcattttgttccattacatctccagcacttaagagtgctggacacataacgagtgtctgacacataacgagtgctgaataaatgtttgttaactgataaaat

SEQ ID NO: 401750 - DNA, 605 bp, Homo sapiens
agcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacagttgtacacagaagaaagcccatatgaggacacagcaagaaggtggctgtcttcaagccaagaagagaggcctcatcagagatggaatgttcctgcacttcggtctggatttctagtgtccagaactgtgagaaaataaatttctgttgtttaagccacc

SEQ ID NO: 401751 - DNA, 1832 bp, Homo sapiens
agcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaa

SEQ ID NO: 401752 - DNA, 1870 bp, Homo sapiens
agcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggataagggagatcttgaaggcatctcgaaagttgcaagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaa

SEQ ID NO: 401753 - DNA, 1421 bp, Homo sapiens
ggagaaaagtccatcctgatcttttttttttccagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaa

SEQ ID NO: 401754 - DNA, 722 bp, Homo sapiens
agcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggataagggagatcttgaaggcatctcgaaagttgcaaggtgatccagatttgccgatgtcttttactttggccatagtggagtctgattctacaatagtctattataaacttactgatggatttatgctgccagaccctcaggtcagttttgaggtaactgacagcaagaagtacaaaaagaggaaaattatgacgtgattttaagtgtgactcaagtcagtcacagaactgccacttcctttgccatagggaaaattcaagaaaaaaagtcttga

SEQ ID NO: 401755 - DNA, 705 bp, Homo sapiens
agcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggaggaataatccatatatatttattaaagatattaacaaaaagcagctctcaccttcttgtgaatcagatccaaatcccttaacgtcttcattgattcagttgtacacagaagaaagcccatatgaggacacagcaagaaggtggctgtcttcaagccaagaagagaggcctcatcagagatggaatgttcctgcacttcggtctggatttctagtgtccagaactgtgagaaaataaatttctgttgtttaagccacc

SEQ ID NO: 401756 - DNA, 448 bp, Homo sapiens
acacttgtggtgaggactcagtaaggttcttgtggactgattgtgtccctctctaaattccccaattcacacactgaagctctaatctccagtgtgattgtttttggagttaggccctatatggaggtaatcaaattaacagaggtcatgagagtggggccttaatccaacaggactaatattcttataaaatggggaagaaacaggataccagagatctctatctctctcccccttctctctctctctctctctctctctctctctctctctgtgtctctctctctttcccagttgtacacagaagaaagcccatatgaggacacagcaagaaggtggctgtcttcaagccaagaagagaggcctcatcagagatggaatgttcctgcacttcggtctggatttctagtgtccagaactgtgagaaaataaatttctgttgtttaag

SEQ ID NO: 401757 - DNA, 1974 bp, Homo sapiens
agcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggataagggagatcttgaaggcatctcgaaagttgcaaggtgatccagatttgccgatgtcttttactttggccatagtggagtctgattctacaatagtctattataaacttactgatggatttatgctgccagaccctcagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaa

SEQ ID NO: 401758 - DNA, 2129 bp, Homo sapiens
agcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggataagggagatcttgaaggcatctcgaaagttgcaaggtgatccagatttgccgatgtcttttactttggccatagtggagtctgattctacaatagtctattataaacttactgatggatttatgctgccagaccctcagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaaaaacccacaaatataatatttcattttatacccccaccactcatccacgtcatgggaaaaaaaattttcgcccaagcttattcttgcgccccaaattgggggttatttgggcaatttcgccctatagggagggcgttcaaacattaatcggcggt

SEQ ID NO: 401759 - DNA, 1584 bp, Homo sapiens
  misc_feature (53)..(53): n is a, c, g, or t
  misc_feature (55)..(55): n is a, c, g, or t
taggtagtgggtacgagcgaaatggcccccacaccaaacttcgggtaaagcgnantgataagggagatcttgaaggcatctcgaaagttgcaaggtgatccagatttgccgatgtcttttactttggccatagtggagtctgattctacaatagtctattataaacttactgatggatttatgctgccagaccctcagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaa

SEQ ID NO: 401760 - DNA, 842 bp, Homo sapiens
agcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaagtatctagaaatgatggaattagatataggagatgccacccaagtttatgtagcgttcttggtttacctggacctcatggaaagcaaaagctggcatgaagtaaactgtgtaggattaccagaactccagctcatctgccttgttggtactgagatagaaggggaggggttacagactgtggtgcctacccccatcactgcttccctcagccataacaggtgagcaggtgattttggtctaagttcctttcccgagtaaagcagtaggaaacattaaacatagtgatgtaatacttttaatgaaatttgggatacagggttcatagctttactcttggctatttgaggaataagttaaatatgagtgttgtattcggccattcttgcattgctataaagaaatacctgagactgagtaatttcttaaaaaaaaaagaagaggtttaagtggctcatagttctgaaggctttacagtaagcatggtgctggcatctactcggcttctagggaggcctcaggaagcttataatcatggaggaagttcgtgaagcaagagcaggcacatcatatggcaaaagcaggagtgagagagagtgttgagggggaggttccac

SEQ ID NO: 401761 - DNA, 452 bp, Homo sapiens
atcccttctttactatagatcattggtagaaaagcagtgtaagctgtttgatcaaaaatttataaactttctattttaattttaaataaaatttaaattacaaattatttttaaagttttaaaaaatctttgagttagagattaccaagagtaaagaaatttcagcaaagccatgtaggatacaggaaaggcgtggaacattcagtattgtaattctaagtcacagagacagaatttctgatgctaccatactggactttccaacttgcctggaatgtcctctgccatgatcactgccaatcaaaatatgattcatccacaaaatcaccaaatcaagctaggcatggtgacacatgcctataatctcaggtacatggaaggctgaagtgggaggattgcttgagcccaggagttcaagaccagcctgggcaatgtagtgagagtgcatctca

SEQ ID NO: 401762 - DNA, 2301 bp, Homo sapiens
ccgaggctataagagggcgcacaagtggcgcggcgcaggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcacgttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggccgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcaagggggctccgagggggcgcagcctcaaaccctgcctttcctttacttttactttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccaaaaaaaaaaaaaaaaaaacacaaaaaaaaaaaacacaaacaaacaaaaaacaaaaaaaaaaaaaaaaaaaacaaaaaaaaaaaaaacaacacaaacaaaaaaaaaaacacagctgcgcaccgcagccgcgccgccccgagactaatacaacaacccagggagggagaggaccacccgacacaacacataaataccaaacaaaaaacataacacacagaagaagaacgacaagagacacccacacaaccacgcggacaaaccactacaaaacacaaacacgccggaagtggcccaactagggtaaggagaaagagaaaagagaggggggagggaagaggagacgactaagggcgcactaccaaaagggggcaaaagagaagaggagcaaaaagaaaaaccccgcgcg

SEQ ID NO: 401763 - DNA, 2080 bp, Homo sapiens
ccgaggctataagagggcgcacaagtggcgcggcgcaggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggccgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcaagggggctccgagggggcgcagcctcaaaccctgcctttcctttacttttactttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccaaaaaaaaaaaaaaaaaaacacaaaaaaaaaaaacacaaacaaacaaaaaacaaaaaaaaaaaaaaaaaaaacaaaaaaaaaaaaaacaacacaaacaaaaaaaaaaacacagctgcgcaccgcagccgcgccgccccgagactaatacaacaacccagggagggagaggaccacccgacacaacacataaataccaaacaaaaaacataacacacagaagaagaacgacaagagacacccacacaaccacgcggacaaaccactacaaaacacaaacacgccggaagtggcccaactagggtaaggagaaagagaaaagagaggggggagggaagaggagacgactaagggcgcactaccaaaagggggcaaaagagaagaggagcaaaaagaaaaaccccgcgcg

SEQ ID NO: 401764 - DNA, 1213 bp, Homo sapiens
  misc_feature (49)..(49): n is a, c, g, or t
  misc_feature (130)..(130): n is a, c, g, or t
ggagcgtaagatgaaagagtgtgagagaccattgggggtctgtaggggnaagggaagtgggggcgtgtgtaaggggcagggtgtgtgaggagaagaggaaccccagcaaagagtagtaataataatggcnaccgtcacacgataatattcgagtaatatgtgcggggactttacaaagcatctcatatgcttcattttaacttctactccaatcctccgaggtgcgtactgttatcaaacccattttacaagacaggaactcagagagggcgcggcccccggggattccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcaagggggctccgagggggcgcagcctcaaaccctgcctttcctttacttttactttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccaaaaaaaaaaaaaaaaaaacacaaaaaaaaaaaacacaaacaaacaaaaaacaaaaaaaaaaaaaaaaaaaacaaaaaaaaaaaaaacaacacaaacaaaaaaaaaaacacagctgcgcaccgcagccgcgccgccccgagactaatacaacaacccagggagggagaggaccacccgacacaacacataaataccaaacaaaaaacataacacacagaagaagaacgacaagagacacccacacaaccacgcggacaaaccactacaaaacacaaacacgccggaagtggcccaactagggtaaggagaaagagaaaagagaggggggagggaagaggagacgactaagggcgcactaccaaaagggggcaaaagagaagaggagcaaaaagaaaaaccccgcgcg

SEQ ID NO: 401765 - DNA, 2321 bp, Homo sapiens
ccgaggctataagagggcgcacaagtggcgcggcgcaggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcacgttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggccgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccgagggtgcggactcggaaggggcgccccccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcaagggggctccgagggggcgcagcctcaaaccctgcctttcctttacttttactttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccaaaaaaaaaaaaaaaaaaacacaaaaaaaaaaaacacaaacaaacaaaaaacaaaaaaaaaaaaaaaaaaaacaaaaaaaaaaaaaacaacacaaacaaaaaaaaaaacacagctgcgcaccgcagccgcgccgccccgagactaatacaacaacccagggagggagaggaccacccgacacaacacataaataccaaacaaaaaacataacacacagaagaagaacgacaagagacacccacacaaccacgcggacaaaccactacaaaacacaaacacgccggaagtggcccaactagggtaaggagaaagagaaaagagaggggggagggaagaggagacgactaagggcgcactaccaaaagggggcaaaagagaagaggagcaaaaagaaaaaccccgcgcg

SEQ ID NO: 401766 - DNA, 2229 bp, Homo sapiens
ccgaggctataagagggcgcacaagtggcgcggcgcaggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcacgttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggccgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcaagggggctccgagggggcgcagcctcaaaccctgcctttcctttacttttactttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccaaaaaaaaaaaaaaaaaaacacaaaaaaaaaaaacacaaacaaacaaaaaacaaaaaaaaaaaaaaaaaaaacaaaaaaaaaaaaaacaacacaaacaaaaaaaaaaacacagctgcgcaccgcagccgcgccgccccgagactaatacaacaacccagggagggagaggaccacccgacacaacacataaataccaaacaaaaaacataacacacagaagaagaacgacaagagacacccacacaaccacgcggacaaaccactacaaaacacaaacacgccggaagtggcccaactagggtaaggagaaagagaaaagagaggggggagggaagaggagacgactaagggcgcactaccaaaagggggcaaaagagaagaggagcaaaaagaaaaaccccgcgcg

SEQ ID NO: 401767 - DNA, 972 bp, Homo sapiens
  misc_feature (660)..(660): n is a, c, g, or t
  misc_feature (836)..(836): n is a, c, g, or t
  misc_feature (877)..(877): n is a, c, g, or t
  misc_feature (902)..(903): n is a, c, g, or t
  misc_feature (926)..(926): n is a, c, g, or t
  misc_feature (941)..(941): n is a, c, g, or t
  misc_feature (952)..(953): n is a, c, g, or t
  misc_feature (965)..(965): n is a, c, g, or t
ccgaggctataagagggcgcacaagtggcgcggcgcaggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcacgttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggccgcggccgcaaatcttgnttagtcatatattaaagagccagctgatgctcttacagttaaaaaaactgtgtagccacattactgttttcaacgtcctgtgtggaaagttgctatcactgtacaattttgcttgagcctttattttacaacagggctttacctctaactcagaattgacgtaagaaggctatttnaaaagtacgataaaaatttgcacaaatcagacttaagaatngagtcagtatgtgtacactttctannatagtatgctgataaggaagggncaatagaggctgccnctaaactctcnnttgaggataatngactgga

SEQ ID NO: 401768 - DNA, 409 bp, Homo sapiens
cacgaggctgtccatggagaccgagccactgactttggtgaccatacctttggtgtttgatgtagacaaccaaagacggaaaagagaagccaatgttccgctacaccaggtacagcaattgccctactgccagtcgaatcagcaaatatctgagcacgagtctgtttttcattaggagattgcagtactctgaaatattatggtcagcatgatgtgtttagtgtagacagataaactcctatttaactgatagtccactcaaaattttatttctccctgaaaaacctgatacagtgtgtaattcagtcagtctttaacagttctaaaaacaaagtaaattttcctgtagtcttttcaacatcaccacaaacaatttgacctctaagctttgacaaaggacttctggcta

SEQ ID NO: 401769 - DNA, 437 bp, Homo sapiens
gcccaaatagacattttttcaaagcagatatagagggggccaataagcacatgaaaagatgctctacagcattaaatattaggaaaatgcaactcaaaacaataagatagcattttatatccactaagatggctgtaagaaaaaagtcaaacaaaaacaggtgttggtgaagttacagaaaaatcgaaatcctcacatattggtggtgggaatataaaatgctgtagctgctttggcaaatggttaggccattcttcaaggagttcaagaccagtctgggcaagatggcaagatcctatctctacaaaaaaattttaaaaattagccaggcatggcagcatgtgcctgtaatttcagctgcttggaaggtggaggcaggagaatcagttgagcccagaaactccaggaggcagtgagctgtgattgcaccactgcac

SEQ ID NO: 401770 - DNA, 406 bp, Homo sapiens
  misc_feature (406)..(406): n is a, c, g, or t
attaggaaggctatggttgctataacaccacaggcatggtatgagtggttgaaatctttcatggtgggataaataacagctgcatctatgataatccaccagcctgtaaaaaatagtacaccagcagcaatggaagcaatagtattgcgcttttccccccagtcaatgcattctgagcatctcaagccctctagaaatccagacatttttttcaggtcagtccagccccgtcgtgcagtggttccggagcccggtgtcgcgccgcgccggcccgcctcactcccccgattttagccaagaaaacaaaacggccacagcctccagacacccggatgcagcagtaccatccacccggctcagtcgcgcagtttccctttttttttttattttccagtaggccaacaan

SEQ ID NO: 401771 - DNA, 412 bp, Homo sapiens
ataaatggactagtcaatgaacttgcccattcttcaaggatgcttagaccgccccgtttagaatgcatctgttggttaaggtctaggatcccatttttggctgcctcagatgcctccacttggcttgctatggctcagctccaccatgcccccctacctctcacattcccattgcacactcccgacctttcaagaagcaggaactggccagttcctgcttcttgaaaggtgcaatagtctcaacataatgaactcaaaatctcagtgcattgaagggtttgcatgccaagttgaccaacgtgcctaaactgtattaactccctatttgcacacttagaattggatcatcagatttgtctaacccacttgaaaggcttagctatctgttcactgaacagtcattatgatgtac

SEQ ID NO: 401772 - DNA, 442 bp, Homo sapiens
tatcaactggtgtttgtcccaacaacagtgtggcagagtcttagttgttcttccaaaatctcttttcccctttttcttgtgcacataactgcctggcttaagaatggacttcccaaccaactctatacctaggtttggccatgtgattaaattgtccccaatgaaatgtgagcaaattgaagtaagtaacttcagccttacttaattaaaagaaaaaagttacttgcctgggactcccttttactgtgaagtgaaaagcaggcacactagtgagctggctgagctgcgtagaggaagacaatgccctggggagcagaccaaggaggtggagggaacctgggaccctgatggagctcacagaggggagtggagccaacctgctgacctgaaatgctcccctgaggagttttacataagaaataaacttccattttatttaaac

SEQ ID NO: 401773 - DNA, 305 bp, Homo sapiens
tatgcagaacaaaagcaactaccaatcaaagtctctgaaacaaatgtgaatcaagcatgggtggctggcctggtgtgctctctgcctactgtctggtggtggtggatgtggtggtggcatcagcaggtcagtggctgaggctacacagtgctggtggtctgatggtcgggcgaccctctcccgctggccgtcctgagcaggagcctcgtgctaacaaggaggccgctaatgagctggccggagctgtggacctgggctggatggcaaatgtgaggaggaacccccgggacatggtaaccagcacg

SEQ ID NO: 401774 - DNA, 306 bp, Homo sapiens
gtcatgggcagtcagagagtgatggggaaagtaatgaataaggaagagagaggtgaggtctatcaaaaaggacgttggaatcctacagtttatccacaggataaaaggaagccaacctcaggcaggcttgcagcattcaagaattgaagctctaagaactaaggtgagctcatcagctccgggagaaggcataggtccagtagagtcgcagactaagcaggtggggaagggggcagttgtacatgcccctctaattctcgcatcatctcacacaacccaagctccatttcctcagaaagccttctg

SEQ ID NO: 401775 - DNA, 746 bp, Homo sapiens
gactttcctactgtttactgttaattctgaaactagagattttcatctgtcttttattcttaccactttctcacggaaaatttgcagctctcccctagagacattactgggagtggtaagcattgtgttgaaatagcagttcagcctgttggcctttgacgtctgatttatgaccagcgtttgtgtgaatgtctgtgtgtgtctttgctcagaactgcatagccacccatgaatccaatggcattgacatcatcacagccctgatcctcaatgatatcaatcctttgggaaagaagaggatggaccttgtgttagaactgaaggcaagtaggaattaaaagcagaagacagtcatttggaaacagtcacttttgtgttttgccttggcacatgcacatgggcaattagtcatgagagtaaatattaaagatagttctttaaatgaatgacccaggttgctagtgctgactacgatgcagaactccaacctttctcttccacgtaaggtatctcatgaggggataggagcttctgaactgttaggtcacacagaatgaagattccttgctccaagctaagaagtgaatcccaacagcatcgagtactaaataccttggttctgaaagtcacaaagagagaaacagtggaaacgccattccctctctggtttctgatttttccccatttgagggaaaagggccggttgaagaatagtacaactaagcctatctaggaccaaaaaaaaa

SEQ ID NO: 401776 - DNA, 441 bp, Homo sapiens
gacagaagatgtgtgtgtttgtatacacatatatctacacattcatccatgtatctttctataactacacaaatatataataaaaagcatgtacttacactaatacttccaattccattccaacaccatgggatttattctagccttcaccttttccatttcatgactccctccagctgccacgattccctgtatgtttacccgtctgcccgtttccctgtgtgtacctgtctcacctctgccacccacctccacggtccccagtgtctccttggctccagctgtaagacctgccagtcctgccacctgaagggaagggaaggggaagaaagaaaggaagtgaaccaattaatacttttaaaagaaaaggaaagggaagataaagcaaggcttttattattttttaataaaataaataaaactgcagataaaatgccattt

SEQ ID NO: 401777 - DNA, 6049 bp, Homo sapiens
cgattgagtcttgcattacaaccccttttgggttaatgtcacagcatataatatagaacttctttttcatgatctttgcaataaattatgttggccaaaaagtcatatgtctgcccattttgaacagtgcactagggttgggggtatgggacagtcgttaagcagcatctaaagtaatcaagcatggatatacgggggaaaaacaaaaatccagacctattctccttttgtgtaactcttgtctatatatgaactctcaatgtattttatatgtgactgatgctgcagatggtagtgtctccttagtgttgtattaaaatggaatttctgcatgcctagcaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcaccgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaacagctgaaatttgttttatttatgcccagtggtcagggtccttcagcaaagtgtaaaatgtttttacagaaccactttgcctgtccaaacgtagtaaaacctgttccctcctcaaatcagtgcttgccctggctgctttttttgacactaattttctctatgctttggtaaataataccacccaatgttgtggaactaggtcaagattaaattccagttaaatggctagtttggtaactaatgcttttactttataaatttgataacttaaaaacaaattaattttttccagtcagtgcagcctgtctccacaaaatttttccatcgtaaggcaagcctaagacagatacctacttttatctgtaagcaaaatggcaatctatgctaacccccacaatgcacacattagctagcaaggacttgcttttcccctgggctttctctttgatctctcacactgcccaacgagatgtggcagtgtgtgtggtttgtctcccaagtcccatccagttcattggaaagttctgcattgacatgccaagttgcagcttttacaggtttgtcatgttccatttgaatcctgtcacttaagatataaatcttcattcagtgtgccagcttcagcagaaaataaacgaaattggaatgccactcctccctccatgcagtagatcctacccttgccgtttgggtgtgaacactaaagctagtagaattgaaacatacaatttgaagtgaaaactccgggggcctttgatgtgtaattgtaattctgcctgcttccttcacattgtgcctttccaacacctctattttaagatcaaggtccaagtcaccttcaaagttacctacccggatgaagaattagtgttatcagggtgaaagtatggtagtactcgctaacatgagagaaagccaatgttacttaattaagccattttatttaatattaacagtttgccacagcagagagccactcagcatctg

SEQ ID NO: 401778 - DNA, 9856 bp, Homo sapiens
gttgctgtcggagagagaaagccgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgtactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaacagctgaaatttgttttatttatgcccagtggtcagggtccttcagcaaagtgtaaaatgtttttacagaaccactttgcctgtccaaacgtagtaaaacctgttccctcctcaaatcagtgcttgccctggctgctttttttgacactaattttctctatgctttggtaaataataccacccaatgttgtggaactaggtcaagattaaattccagttaaatggctagtttggtaactaatgcttttactttataaatttgataacttaaaaacaaattaattttttccagtcagtgcagcctgtctccacaaaatttttccatcgtaaggcaagcctaagacagatacctacttttatctgtaagcaaaatggcaatctatgctaacccccacaatgcacacattagctagcaaggacttgcttttcccctgggctttctctttgatctctcacactgcccaacgagatgtggcagtgtgtgtggtttgtctcccaagtcccatccagttcattggaaagttctgcattgacatgccaagttgcagcttttacaggtttgtcatgttccatttgaatcctgtcacttaagatataaatcttcattcagtgtgccagcttcagcagaaaataaacgaaattggaatgccactcctccctccatgcagtagatcctacccttgccgtttgggtgtgaacactaaagctagtagaattgaaacatacaatttgaagtgaaaactccgggggcctttgatgtgtaattgtaattctgcctgcttccttcacattgtgcctttccaacacctctattttaagatcaaggtccaagtcaccttcaaagttacctacccggatgaagaattagtgttatcagggtgaaagtatggtagtactcgctaacatgagagaaagccaatgttacttaattaagccattttatttaatattaacagtttgccacagcagagagccactcagcatctg

SEQ ID NO: 401779 - DNA, 6809 bp, Homo sapiens
gttgctgtcggagagagaaagccgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaaggcaagtaggaattaaaagcagaagacagtcatttggaaacagtcacttttgtgttttgccttggcacatgcacatgggcaattagtcatgagagtaaatattaaagatagttctttaaatgaatgacccaggttgctagtgctgactacgatgcagaactccaacctttctcttccacgtaaggtatctcatgaggggataggagcttctgaactgttaggtcacacagaatgaagattccttgctccaagctaagaagtgaatcccaacagcatcgagtactaaataccttggttctgaaagtcacaaagagagaaacagtggaaacgccattccctctctggtttctgatttttccccatttgagggaaaagggccggttgaagaatagtacaactaagcctatctaggaccaaaaaaaaa

SEQ ID NO: 401780 - DNA, 6714 bp, Homo sapiens
gttgctgtcggagagagaaagccgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaaggcaagtaggaattaaaagcagaagacagtcatttggaaacagtcacttttgtgttttgccttggcacatgcacatgggcaattagtcatgagagtaaatattaaagatagttctttaaatgaatgacccaggttgctagtgctgactacgatgcagaactccaacctttctcttccacgtaaggtatctcatgaggggataggagcttctgaactgttaggtcacacagaatgaagattccttgctccaagctaagaagtgaatcccaacagaaccaaggtatttagtactcgatgctgttgggattcacttcttagcttggagcaag

SEQ ID NO: 401781 - DNA, 2681 bp, Homo sapiens
gttgctgtcggagagagaaagccgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagctgccacgattccctgtatgtttacccgtctgcccgtttccctgtgtgtacctgtctcacctctgccacccacctccacggtccccagtgtctccttggctccagctgtaagacctgccagtcctgccacctgaagggaagggaaggggaagaaagaaaggaagtgaaccaattaatacttttaaaagaaaaggaaagggaagataaagcaaggcttttattattttttaataaaataaataaaactgcagataaaatgccattt

SEQ ID NO: 401782 - DNA, 475 bp, Homo sapiens
aaaatccagacctattctccttttgtgtaactcttgtctatatatgaactctcaatgtattttatatgtgactgatgctgcagatggtagtgtctccttagtgttgtattaaaatggaatttctgcatgcctagcaggagcttgaaccaagtccacccctgcggcagctggaagaccataaaagggtacgtagtcttgagtcttgggtatcgggagctaatgatcaatgaccgtaacacctccatcagccacacactgtgattgagagacagcttttgttgttgatattgttaaagcattaattgactcaagagcaatcacagccatgtatataaatgaaactaaatagtggttctgcccattgtctacctgatcagagcactgtaaccagctggcctccaaataatgaccaagtaaacttttcatgtccttttttcttttctgtggtggctttctatttaggtgaaatataaaa

SEQ ID NO: 401783 - DNA, 300 bp, Homo sapiens
cagaggtaaatctatggttcagtatgcgatttgacgtacaggaagtatctgggtctaatgatgaaactttttaactttccagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactg

SEQ ID NO: 401784 - DNA, 10947 bp, Homo sapiens
gttgctgtcggagagagaaagccgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcaccgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaacagctgaaatttgttttatttatgcccagtggtcagggtccttcagcaaagtgtaaaatgtttttacagaaccactttgcctgtccaaacgtagtaaaacctgttccctcctcaaatcagtgcttgccctggctgctttttttgacactaattttctctatgctttggtaaataataccacccaatgttgtggaactaggtcaagattaaattccagttaaatggctagtttggtaactaatgcttttactttataaatttgataacttaaaaacaaattaattttttccagtcagtgcagcctgtctccacaaaatttttccatcgtaaggcaagcctaagacagatacctacttttatctgtaagcaaaatggcaatctatgctaacccccacaatgcacacattagctagcaaggacttgcttttcccctgggctttctctttgatctctcacactgcccaacgagatgtggcagtgtgtgtggtttgtctcccaagtcccatccagttcattggaaagttctgcattgacatgccaagttgcagcttttacaggtttgtcatgttccatttgaatcctgtcacttaagatataaatcttcattcagtgtgccagcttcagcagaaaataaacgaaattggaatgccactcctccctccatgcagtagatcctacccttgccgtttgggtgtgaacactaaagctagtagaattgaaacatacaatttgaagtgaaaactccgggggcctttgatgtgtaattgtaattctgcctgcttccttcacattgtgcctttccaacacctctattttaagatcaaggtccaagtcaccttcaaagttacctacccggatgaagaattagtgttatcagggtgaaagtatggtagtactcgctaacatgagagaaagccaatgttacttaattaagccattttatttaatattaacagtttgccacagcagagagccactcagcatctg

SEQ ID NO: 401785 - DNA, 10992 bp, Homo sapiens
gttgctgtcggagagagaaagccgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcaccgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaacagctgaaatttgttttatttatgcccagtggtcagggtccttcagcaaagtgtaaaatgtttttacagaaccactttgcctgtccaaacgtagtaaaacctgttccctcctcaaatcagtgcttgccctggctgctttttttgacactaattttctctatgctttggtaaataataccacccaatgttgtggaactaggtcaagattaaattccagttaaatggctagtttggtaactaatgcttttactttataaatttgataacttaaaaacaaattaattttttccagtcagtgcagcctgtctccacaaaatttttccatcgtaaggcaagcctaagacagatacctacttttatctgtaagcaaaatggcaatctatgctaacccccacaatgcacacattagctagcaaggacttgcttttcccctgggctttctctttgatctctcacactgcccaacgagatgtggcagtgtgtgtggtttgtctcccaagtcccatccagttcattggaaagttctgcattgacatgccaagttgcagcttttacaggtttgtcatgttccatttgaatcctgtcacttaagatataaatcttcattcagtgtgccagcttcagcagaaaataaacgaaattggaatgccactcctccctccatgcagtagatcctacccttgccgtttgggtgtgaacactaaagctagtagaattgaaacatacaatttgaagtgaaaactccgggggcctttgatgtgtaattgtaattctgcctgcttccttcacattgtgcctttccaacacctctattttaagatcaaggtccaagtcaccttcaaagttacctacccggatgaagaattagtgttatcagggtgaaagtatggtagtactcgctaacatgagagaaagccaatgttacttaattaagccattttatttaatattaacagtttgccacagcagagagccactcagcatctg

SEQ ID NO: 401786 - DNA, 11091 bp, Homo sapiens
gttgctgtcggagagagaaagccgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagctaatttccattgatgaattggataatgctgagcttcctccagctccggattctgagaacgccactgaggagcttgaaccaagtccacccctgcggcagctggaagaccataaaaggggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcaccgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaacagctgaaatttgttttatttatgcccagtggtcagggtccttcagcaaagtgtaaaatgtttttacagaaccactttgcctgtccaaacgtagtaaaacctgttccctcctcaaatcagtgcttgccctggctgctttttttgacactaattttctctatgctttggtaaataataccacccaatgttgtggaactaggtcaagattaaattccagttaaatggctagtttggtaactaatgcttttactttataaatttgataacttaaaaacaaattaattttttccagtcagtgcagcctgtctccacaaaatttttccatcgtaaggcaagcctaagacagatacctacttttatctgtaagcaaaatggcaatctatgctaacccccacaatgcacacattagctagcaaggacttgcttttcccctgggctttctctttgatctctcacactgcccaacgagatgtggcagtgtgtgtggtttgtctcccaagtcccatccagttcattggaaagttctgcattgacatgccaagttgcagcttttacaggtttgtcatgttccatttgaatcctgtcacttaagatataaatcttcattcagtgtgccagcttcagcagaaaataaacgaaattggaatgccactcctccctccatgcagtagatcctacccttgccgtttgggtgtgaacactaaagctagtagaattgaaacatacaatttgaagtgaaaactccgggggcctttgatgtgtaattgtaattctgcctgcttccttcacattgtgcctttccaacacctctattttaagatcaaggtccaagtcaccttcaaagttacctacccggatgaagaattagtgttatcagggtgaaagtatggtagtactcgctaacatgagagaaagccaatgttacttaattaagccattttatttaatattaacagtttgccacagcagagagccactcagcatctg

SEQ ID NO: 401787 - DNA, 3454 bp, Homo sapiens
ctctgttcagtagacttagggactgtttccatcagggttaggcctgatccacctgaacgcacagtgaatatccctcctggctgtgtcacaccacacttggagaagtcgcaattgagacaggggacatgaaaagagatgcagttttcagtttaaaagttgaatgcccaatttaatttctacccaagtagatgaggtctcacttgagctgtgccccaggctccgcagaccaaagggtcgcaagggacccagactgatccagacacctctcttttccaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaaggaaacttttatatctgttgcctagttttgtacatggatctcattttacaagagaatctctctgcaaaaaaaaaaaaaacagtttaaaaatgcattgaaagcagagttctgaaatgagtaaagtttgtaaatgcatatataaaaatatttaataaatgatgcagaatatacagtgactggttggtggctttcatttggcatttgtgacttaactgctattccatttatgtactttctttaggatcagtttgaagtacagtcggtttgattaccaggttaattcagaaaatgtttacctgattatttaaaaaaacacttgctgttgttatgacagctctgaggagaattattagaacaaacattggggagtatttagtacaacattcattcattcttctggattagtgactgccagccaggctgtcgggagcgccctactaaatctcctgtctcttctgcttttactgggggatctttaatttgctgtgtgccatgtggaagtatcgggaacagctgaaatttgttttatttatgcccagtggtcagggtccttcagcaaagtgtaaaatgtttttacagaaccactttgcctgtccaaacgtagtaaaacctgttccctcctcaaatcagtgcttgccctggctgctttttttgacactaattttctctatgctttggtaaataataccacccaatgttgtggaactaggtcaagattaaattccagttaaatggctagtttggtaactaatgcttttactttataaatttgataacttaaaaacaaattaattttttccagtcagtgcagcctgtctccacaaaatttttccatcgtaaggcaagcctaagacagatacctacttttatctgtaagcaaaatggcaatctatgctaacccccacaatgcacacattagctagcaaggacttgcttttcccctgggctttctctttgatctctcacactgcccaacgagatgtggcagtgtgtgtggtttgtctcccaagtcccatccagttcattggaaagttctgcattgacatgccaagttgcagcttttacaggtttgtcatgttccatttgaatcctgtcacttaagatataaatcttcattcagtgtgccagcttcagcagaaaataaacgaaattggaatgccactcctccctccatgcagtagatcctacccttgccgtttgggtgtgaacactaaagctagtagaattgaaacatacaatttgaagtgaaaactccgggggcctttgatgtgtaattgtaattctgcctgcttccttcacattgtgcctttccaacacctctattttaagatcaaggtccaagtcaccttcaaagttacctacccggatgaagaattagtgttatcagggtgaaagtatggtagtactcgctaacatgagagaaagccaatgttacttaattaagccattttatttaatattaacagtttgccacagcagagagccactcagcatctg

SEQ ID NO: 401788 - DNA, 5401 bp, Homo sapiens
gttgctgtcggagagagaaagccgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggagatgggagcaggtgagacgcagagccccagtactgagaggaggaagccctcttacagggccccttgcccaccccaagtccgtgtctgaaacacggagcgggtgctgcttcaacccgcatttaatgctgtgtaagtagcgataaccacgtacgagtctgtctggttgatttctaatgtgactcctctggtatttcctcctggtaataaatacaagtgtgacctttcagattgcatatctcaaaagtaacattgctaatgttttataataaaatatattatgtgtgttttggttggtgaaaataatacagactacattttaaaagataa

SEQ ID NO: 401789 - DNA, 2378 bp, Homo sapiens
gttgctgtcggagagagaaagccgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctgaggcacaagaatcacttaaacccaggaggcagaggttgcagtgagccgtgatcgcaccactgcactccagcctgggcaacagagtgagactctgtctcaaaaaa

SEQ ID NO: 401790 - DNA, 272 bp, Homo sapiens
tgtttgggcacggtgactgaaatacatttgtgtgagatgctctcgttgctctcatgaagagtttggcacagtccgtgccatctgactgttcctgtcattgttctcaggtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctg

SEQ ID NO: 401791 - DNA, 419 bp, Homo sapiens
tgaagagtgaataggagagagacatttggctggagatttgaaattttttcccataatgtctcttgtagtacttaataaatcatttttttaaaaagatcaaaaattaaaactgaaaaattcaccagtggcttccagaccaggaaatgggcagaaacaacaaatgcagtaaacttcaaagccagaaaacaaaaaaacaaatgaacagaatattcaaaagtggagtggaggccgggtgtagctggcattacaggcgtgacgaccatgcccggctgccattgacagttttttaaaaagcagcaataggacatcatttttgatacagagaatgatttggagcagggaaaatggagatgaagggacctgttaggaggctagcgtcgaatctaggctggagtctatgccataccatctgaatacat

SEQ ID NO: 401792 - DNA, 182 bp, Homo sapiens
agcttgcagcctgaaacatcagtcagatgagatcttgggtgaagagaaaagactgtataacatatttactgtctgctgagtgcataagaatgcagtctctgccagtcactggagacatcaagccctgaccactacaggaagcacatggtttccattacataaaatttacacatttggatttg

SEQ ID NO: 401793 - DNA, 2144 bp, Homo sapiens
attcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcgggccgccgtctccgtgcccggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcaccccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagtcaaaaaaaaa

SEQ ID NO: 401794 - DNA, 2435 bp, Homo sapiens
attcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcgggccgccgtctccgtgcccggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagagactgaattcccttcaggagcttcaacttcttgaaatcatgtgcaattatttccaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcaccccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagtcaaaaaaaaa

SEQ ID NO: 401795 - DNA, 2585 bp, Homo sapiens
attcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcgggccgccgtctccgtgcccggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagagactgaattcccttcaggagcttcaacttcttgaaatcatgtgcaattatttccaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataagacggtagtgaggatgagacccagtggtgtttgtgaatttctcatcctactccttgccacgtggagacctccacaaacgcagtcatcaggactctgaatttcggggtcgtttgcaaggccagcttcctggggcttctgcttggaattcagcctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcaccccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagtcaaaaaaaaa

SEQ ID NO: 401796 - DNA, 2378 bp, Homo sapiens
attcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcgggccgccgtctccgtgcccggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcaccccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagtcaaaaaaaaa

SEQ ID NO: 401797 - DNA, 1949 bp, Homo sapiens
attcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcgggccgccgtctccgtgcccggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagagactgaattcccttcaggagcttcaacttcttgaaatcatgtgcaattatttccaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataagactctgaatttcggggtcgtttgcaaggccagcttcctggggcttctgcttggaattcagcctcctccagctggtgatctcgggtcccgtgcagcagtcgcctcacgccgcgctccccccggggttctaccccaaatcgaaagccacacggaaggggcgaggaggagcatgtaacggggggcaagcggcatgggacaccagaggccgagagcaatgacacgcaggcgccacgcacggcggccagaacgagggcccccacagcagcgcatcaaacggcgagcgggcgca

SEQ ID NO: 401798 - DNA, 1779 bp, Homo sapiens
attcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcgggccgccgtctccgtgcccggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagagactgaattcccttcaggagcttcaacttcttgaaatcatgtgcaattatttccaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataagtaagtatcctcaggactcctagctgggccagcttgctggagcagggtggagggaggcaagacagggcgagcccctttgtcctgggttctttggggagagcccagtaagcacatgatga

SEQ ID NO: 401799 - DNA, 1727 bp, Homo sapiens
attcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcgggccgccgtctccgtgcccggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagagactgaattcccttcaggagcttcaacttcttgaaatcatgtgcaattatttccaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagaggtggagtctcgcttctttgcccaggctggagtgcagtggtgcgatctcggctcattgcaacctctgcctcccgggttctagtgattctaccgcctcagcctcccaag

SEQ ID NO: 401800 - DNA, 2328 bp, Homo sapiens
attcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcgggccgccgtctccgtgcccggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcaccccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagtcaaaaaaaaa

SEQ ID NO: 401801 - DNA, 1993 bp, Homo sapiens
attcttgctggtggaaagcaccgtgaaatcaaccagcggcagctctgaacgcgacgcacagcccgcgagggagcctgggcaaggacggagcgggcctgcaccggcggttgggcgggctccgggggcggggtccacctgggaccgcggcgcgcccctcaccgctcgcgccgccagggggcgccctccggagagcgcgcctaggccgcggcctgcgcttggcccctgcgggccgccgtctccgtgcccggcattcggccgctgttcggctgcgcggcggcagctcccggcggctcctggcggcgccgcagtcggaccttcgggcgcctgctggccggcggcagcagcgatggccccctgagcaggcagggagcaggcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccatcgtggacaagggccccgtggagctgctggaggagttcgtgttccaggtgcccaaggagcgcagcgcgcagcccaagagactgaattcccttcaggagcttcaacttcttgaaatcatgtgcaattatttccaggagcaaaccaaggactctgttcggcagattattttttcatcccttttcagccctcaagggaacaaagccgatgacagccggatgagcttgttgggaaaactggtctccatggcggtggctgtgtgtcgaatcccggtgttggagtgtgctgcctcctggcttcagcggacgcccgtggtttactgtgtgaggttagccaaggcccttgtagatgactactgctgtttggtgccgggatccattcagacgctgaagcagatattcagtgccagcccgagattctgctgccagttcatcacctccgttaccgcgctctatgacctgtcatcagatgacctcattccacctatggacttgcttgaaatgattgtcacctggatttttgaggacccaaggttgattctcatcacttttttaaatactccgattgcggccaatctgccaataggattcttagagctcaccccgctcgttggattgatccgctggtgcgtgaaggcacccctggcttataaaaggaaaaagaagccccccttatccaatggccatgtcagcaacaaggtcacaaaggacccgggcgtggggatggacagagactcccacctcttgtactcaaaactccacctcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataagactctgaatttcggggtcgtttgcaaggccagcttcctggggcttctgcttggaattcaggtagggcgcggtcattctcggctctgaggagactgtggccagctgttctgtgtgtcccagcgcagcagagagccgcagaggctgacgtggaggccacctgtgtgggctgcgcgcccgggagtgctacggccggagctccgtgggccacaggccccgtgcagagcccactcccacgcatcctcgcctgtggggtcctggctctgccactgcttctccgtgtccaccgcctggacccccgggtggtccgtgcctgtgtcggtgcctctcctggg

SEQ ID NO: 401802 - DNA, 1073 bp, Homo sapiens
gtacccggcgcgtcgggtgcagctgcagcgtcctgcaagtgctcatgacgctgcagctgcacctgaccgagaagaatctgtatgggcgcctggggctgatcctcttcgaccacatggtcccgctggtagaggagatcaacaggttggcggatgaactgaaccccctcaacgcctcccaggagattgagctctcgctggaccggctggcgcaggctctgcaggtggccatggcctcaggagctctgctgtgcacgagagatgacctgagaaccttgtgctccaggctgccccataataacctcctccagctggtgatctcgggtcccgtgcagcagtcgcctcacgccgcgctccccccggggttctacccccacatccacacgcccccgctgggctacggggctgtcccggcccaccccgccgcccaccccgccctgcccacgcaccccggccacaccttcatctccggcgtgacctttcccttcaggcccatccgctaggctggcccgtgtgtgccttctgcgctctcgctggacgaagcctttcgagatggaaggggtggccggactcccagaagagaacctcggggaaggggtcgggcagcccctccccgccggcagaaccgtcttggtgtcacggagtccaggtgcttcccacccggtcgcattctttgacatgcagattggatggtggagggaagagtccagcctctgccgagagcctgctgcgtgcatttttaaaagatgccgatcctgggagcctctgttctctgcgcatttcagacacagcctgtgtggcgaggagtgtgacggcaggagccacgggtgcaagcccgtgtgtctggcctctttcctcgtgaagacgatgtgtccccgccagaaaaagtgggctccttctgcagccccgtgagctgagcccaggctgcgtagtgaccacaagcttatgtgcagcactgctcagggaggctgtcaggaattcccctcacctcggaaaggaacttctcagttttattgggggtgtctaaatttcctttcatatgttcaaataaatttttctaaacagtcaaaaaaaaa

SEQ ID NO: 401803 - DNA, 271 bp, Homo sapiens
attttctggttgacaattggttgagtttggctaaagacctgggatcaaaggaatgtcaggttagcataagaggttgtggagaccaaagtcttatcatgctgatgaagcttttagctagcgggcttcagagacaacaggttgcaaaatgttccttatcagacctaaatgtgttgatgttaatgctggggaggtataatgaggaatattccacccccacgtcccatgatggcctgaacctgtctctcaggttcaattttaagagccctggctg

SEQ ID NO: 401804 - DNA, 476 bp, Homo sapiens
attctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacc

SEQ ID NO: 401805 - DNA, 435 bp, Homo sapiens
cctttaaggaaaaaactggcaaccactgccttagagcaatgagggtctctacagaccaagcgtatatgtcttaggaatatggatctcctcatctttagtgtgaaaaacgatgctgacaaatgcaggaaaagaaatggaatgatggagatccacttttaacaatgctggtttatgtgcagtgaacttgacagtaactactttttaatttactgatgccatgaacagtccaaggaaaaaatccttttctagattagccgatttcactgtattaaagataatttttaatgtacatcaaaagacgtcatcaagagaatgaaaagacaagccataaactgggaaaaggtatttccctcaaaacccacaatgagtagaacccagattatgtaaagaactcctaaaaatcaatcagaataaaaaataatcaactgggaaatg

SEQ ID NO: 401806 - DNA, 1659 bp, Homo sapiens
aaagagtgtaatctcacgtatcactaaggtgctgatgagtcccaaatcataatacctaccatgccttttctgtatgacatttccagctgttggacatctttttgttttttgtttttttctcccctagacggagtcttgctctgtttcccaggctggaatgcagtggcacgatctcagctcactgcaacctctgcctcccaggttcaagcgattcttctggtctcagcctccggagtagctgggattataggcacatgccaccacgcccagccaatttttgtatttttagtagagatggggtttcaccatgttggccaggcttgtctcaaactcctgaactcaggtgatccaccagcctcggcctcccaaagtgctgggattacaggcatgagccaccacgcccggccttttttttttttcttttctttttgagatggagtcttgccctgtcgcccaggctggagtgcaatggcgcgatctcggctcgctgcaacctccgcttcccaggttcaagcgattctcctgcctcagcctcccgagtgtgggattacaggtgcgcaccaccacgcccagctaatttttttgtatttttagtagagacggggtttcaccatgttggtcaggctggtcttgaactcctgacctcgtgatccacctgctttggcctcccaaagtgctgggattacagacatgagccaccacccccagctgctgttagacatctttatctggatgtcctacagataactcaacatgacttcactggttgtccattgcagttaaagcatgactgtcctccaaagctagaaacatgagaatcatctttaacaaattgggtatttctttaattcaacagatattcttttattacttgccattctgctaggcctgctgagagctggggatacagtgagagctggggaacagaacagggatggtcctaatctttatggagaaccattgggtggtccattgggtgagatggacatttctccaggaatcccacaaaaatggaatcatgaacttcaagaagaggtcatgtagggaaaggacacaatggggtaagagtatataacagagggcctgacttagtgggaagagagggtggacaggggagactcaaaatggcttaagcaaaatatcaaagaagagctaagtgaaagtagaatattgaggaaagaatattccctgcagaagccctgtgttgttttttttttttttcgatttataaatagtttatcctgttcacattatgcagaatttcagtgtcgttaatccacaatgttagtacggtaacagaaacataaaggagaaaaaaggcaggtggggggaggttcatagtgtggcctgacatagtctaagggttctctcctgtagtatgcatctcctgcaggcaagtattaatatcacttcattgtttgaaggacagtacactatccaggattcatttattgttcaggtgtcttttctaaagtatgagaaaacaggaataaattcaataatgaatatctgcaattcaaaccaatttaactacaggtcagtggtgtctttcttatctattatcacaaacatcccagttgcctccatctaaaaatttctttcaaaagttaagacacaattaattatatcttattaattccctcaaaagcaaaaaaaaac

SEQ ID NO: 401807 - DNA, 539 bp, Homo sapiens
caaacatatccatcatctcaaatttgtgtgtcagtatctgtgtgtgtatgcatgtgtgtgtgtgtgtgtgtttgttttgggtaagaacacttaacatgatatctgtcctcaacgtttttcaaactgcacaatgtcatattgttaatgataggtactacgttgtgcaatagatctctataactcattcatcttgcataactgaaactttatacacatcacagaacaattcttcatttccctcttctccagcccctggcaactatcattctattctctgcttttatgagtttgacaattttagataccacatatatatggaatcatgcaatatttgtcctgtgatgggcttagcataatgtctcctaggttcatctatgttgttacaaatggcaggatttccttttcctttaaggctgaaaaatatgacatatatagtcatccctcagtatccacagggattggtttcaagacctccatggataccaaagtctacagatgctcaaatatctcatatattaataaaatgatatagaattaat

SEQ ID NO: 401808 - DNA, 748 bp, Homo sapiens
ggcgatttgacattgccatcacgttcaagcatgtgatcattttcctaagtccaggatagatcctagggttctctctctagattttaaaagggtcaccaggtgactgatgatttgctagggatggaaaccactgttatagggtccactcctttagatctatgtctaattctttgtggtggttgtttttgtttttgggagttaggaatgtgttaaaaagagctgatcagagcttttaacatgctcatcagagaaacacgcatgatcagtaaattcagcaattttcaggaggttcacagatgcccggtggcaaagccctgaatatcatggtaagacggggagagcatgaactaatgttaaggaatgggttttgatgttgctactgaacaaagagcctttggagaatgcatgcaagactgggtggaaagtaggttctatatagttctgggcactgttcagtgtgctgccctaattctctagtttagtaatcccgtgaaactccacgtgagcactttattaggacaaatgttttcaatggaagctttacaccattacatgccactataaaagacttgcttctggaagcaatgagtagacaagaaaaagggattcacgaggtctgatggtgactcattctaaactttaaacagtgatcttcagaaattcatggactgcagcttgctgccggcactcatttaatgttacataaacatgctctttgagtctgaagtaaatctgattttcaatgtga

SEQ ID NO: 401809 - DNA, 1056 bp, Homo sapiens
ccagcagtggaagcattcctgtctggactccttcagagataaggaaattatcttgacaactcaggggcaggccacagatgctcagataccagtgtctggaaggtctcatccctttgagccacactgtcctaagaagaactggatctggtagtaacatgctggcacctgggtctcttgttgataaaggggaaacctctaaattttgtactacatggaatgtggtccctgattgctggctctgtggtctgcagacctgttgatgtagctcatccaagactgcttagacactctcctgaaggaccagttggaagatttcttatctagggtgtcctaaaaagagatgttacatttcttgtggtcatttaacattggcatcctctctattgggcagctctgtcgggctaagtctgttcagaccattcatttcttcttcgttctccaaaagatggtgagcaggtagtcgccattcttagttgaaattgcccttcaggtttttatttcccgaattacgtaatccttacattattttctcttgaaaatctttgctaagttctgcatactcatcttcagttgctatgcacagaatcaagtcttgtcagagtaacgctcaagtccagcatcttcccttgtgtagatcacctgtatttatttgcctgcttgtaccagcattggtggtgtgagtgggagcctaagtgacctgtcagtgtcacagcgagtcctgagccctgtgtgtgtcctgagactcaggctgtgcagcgggttcgctgagatgctgagcctccatgttggggtcagccaggaccccagtgcgtcatgccagttgtttcattttctctctaggctaaaagttgttgttgttgttgttgttgtttgagacagagtttcgctcttgttgcccaggctggagtgcaatggtgtgatcttggctcactgcaacctccgcttcccaggttcaagtgactttcccgccctagtctctcaagtagctgggactacaggcatgtgctaccatgcctggctaattttgttttgtattttattttttttgagacggag

SEQ ID NO: 401810 - DNA, 676 bp, Homo sapiens
tatctcccttacgtctcatctcccttaccgtctcacctcccttacgtctcatctcccttaccgtctcatctcccttaccgtctcatctcccttaccgtctcatctcccttaccgtctcatctcccttaccgtaatccttacattattttctcttgaaaatctttgctaagttctgcatactcatcttcagttgctatgcacagaatcaagtcttgtcagagtaacgctcaagtccagcatcttcccttgtgtagatcacctgtatttatttgcctgcttgtaccagcattggtggtgtgagtgggagcctaagtgacctgtcagtgtcacagcgagtcctgagccctgtgtgtgtcctgagactcaggctgtgcagcgggttcgctgagatgctgagcctccatgttggggtcagccaggaccccagtgcgtcatgccagttgtttcattttctctctaggctaaaagttgttgttgttgttgttgttgtttgagacagagtttcgctcttgttgcccaggctggagtgcaatggtgtgatcttggctcactgcaacctccgcttcccaggttcaagtgactttcccgccctagtctctcaagtagctgggactacaggcatgtgctaccatgcctggctaattttgttttgtattttattttttttgagacggag

SEQ ID NO: 401811 - DNA, 539 bp, Homo sapiens
cagttgctatgcacagaatcaagtcttgtcagagtaacgctcaagtccagcatcttcccttgtgtagatcacctgtatttatttgcctgcttgtaccagcattggtggtgtgagtgggagcctaagtgacctgtcagtgtcacagcgagtcctgagccctgtgtgtgtcctgagactcaggctgtgcagcgggttcgctgagatgctgagcctccatgttggggtcagccaggaccccagtgcgtcatgccagttgtttcattttctctctaggctaaaagttgttgttgttgttgttgttgtttgagacagagtttcgctcttgttgcccaggctggagtgcaatggtgtgatcttggctcactgcaacctccgcttcccaggttcaagtgactttcccgccctagtctctcaagtagctgggactacaggcatgtgctaccatgcctggctaattttgttttgtattttattttttttgagacggagtcttgctctgtcgcccaggctggagtgcaatggtgcgatcttggctcact

SEQ ID NO: 401812 - DNA, 382 bp, Homo sapiens
agaaaagtagctgcagccgccacctggcagccttgggacgctggctcaggccctgagtgcccccttgggtgccccgccccccaacagagctcctgaggctgaggtcaggctgcctgccttggctgccaccaacgcacagagctgcatgcaagccgggaggcgggagcacggccggcctcaccctgtgagagcagagtcacaggctccgggctgttgttgtggggagggcctggggcttcccgtggccactgctggcctggctgggcctcctcagccgtggccctcggggcctgcacctcagagcggtgactggcctcactgtgacccacggacgtctactgtgacttcctccttagctccctgaagacacccagggctgggc

SEQ ID NO: 401813 - DNA, 377 bp, Homo sapiens
gtcgaggtggacagatcacctgaggtcaggagtttgaggccagcctggccaacatggtgaaaccccgtctctactaaaaatacaaaaattagccaggtgtggtggcacgcgcctgtaatcccagctactcgggaggctgagacaggagactcacttgaacccaggaggtggaggttgcactgagccaagattgtgccactgcactccagcctgggtgacagagcgagactccatctcaaaaaaagaaaagaaaaaaaaagacccacttcttgactgtttccaactatcttgttcttccttaacatagtgtgcatatctgttaacagcagcacttataattatagtatcattgctgtaattaatatccttggctgtct

SEQ ID NO: 401814 - DNA, 363 bp, Homo sapiens
ccacatttgcaggaggctccaaaggctccctctgttaccctactctaacaggtagctgaagcatatctttttaagctcccatgtttagtttttcactaatatggatagacgcttttctaaactaggacacacgtgactgtgtacggaaacaaggagtttgatagtcactatttctagaagattctgggtcattgtatggatgtcagtggctggcctgggcattgatgtggatgaaatggtgtggattaggggtctgatgcagtggctgttttaacctttaaacccattggcactgataccaactttggcttcagaaatactgaaattgaggtgccagtggtacagtcccatggagatgtctaa

SEQ ID NO: 401815 - DNA, 206 bp, Homo sapiens
aggaagactttagcactgaggtcagtcttcacctgcacttcagccatccatttccatggctgcactccaaaccagtcttacctagaactgctatgctttattataagtaaaactgctccacttttaaaaccttaaatataattagctgagcgtggtggctcatgcctgtaatcctagccacccgggaggctgaggcaggagaatcg

SEQ ID NO: 401816 - DNA, 244 bp, Homo sapiens
cactgtgctccggccaacagttggttttgtgtgctctactgtgctgactctgaggcatgatgtattaaaagaatgatcccgagtcctgcccgctgctgtctactgacctgcttggagctcacctgcctgtacccagcatctgtcactgcctggagtagttccttacttttggcattactgagaaaaggcagggtgcgtgtcacgtaagtgtaaaaccaaaacaaaccagaccccaaaaaactaa

SEQ ID NO: 401817 - DNA, 446 bp, Homo sapiens
agacccctggaacctgtggatatgtcaggtttcatggccatgggaattgacattatacaaggaattcaggttgctgatcaactgatgttaaaataaggaatatattcaggtttatctgatggttccagtgtaataatcagggtccgtaaaagtggaagaagcaggcagagaagagatcagaaggagatgtttgaaggaggtcagagagatgcaacgtgagaaggactcagctactgctgcctttgacaatggaggaaggggccatgaacttaaggaacgcagcagtctctgaaagctggaaaaggagaggaaatgggttttcccctggagcctccagaaaagagcacagccctgccaatactttgactttagtccattgagacctgtgtcagacttctgacttctagaactatcagagaataaatgtgtattaagccaaaaaaaaa

SEQ ID NO: 401818 - DNA, 5159 bp, Homo sapiens
  misc_feature (225)..(225): n is a, c, g, or t
  misc_feature (297)..(297): n is a, c, g, or t
  misc_feature (1002)..(1002): n is a, c, g, or t
  misc_feature (1043)..(1043): n is a, c, g, or t
  misc_feature (2431)..(2431): n is a, c, g, or t
  misc_feature (2659)..(2659): n is a, c, g, or t
taatactcctttattccctgttttaaaaatttttttaaatttgatacaataattatacataataatggagtaccatgtgagattcaatccacatatacattgtgaaatgatcaaattaggatagttagcatgcacatcacccccaaataattattacttttgtggtgagaacacttaaaattgtctcttttagaaatatacgttattattaaccatagtcacctngctgtgcaatagaacaccagaacttattcctcctaaatgtaactttttacccattgaccactccctcctcanccccctctctcctccccacccctggtaaccactgttctgttatctcctatgatagcaactttttagcttctgcatgtgagattgtacggtagttgcctttctgtgcctggattatttcatttagcataatgtccttcgggtatatccctgttgctgcaaaagacaggatttctctctctttttctggttgaatagtattccattgtcagagaatgttgtaagactaggaaaggaacactgcaggctggagccctggggaaatggtctgaggcaggtggtgggactagagctggggtctggcaaacaggctgggtttgattgtcagcataatagagagcactcatgtgccagctgggtgggaggagcagccgagtgaagaaggggaagcctctcaggaagcatgtgcagggtttatggtaatgagcagaccagcaggtacgtagtgggagaggggtgtgatggggcagaggaacttacgttatgatagtacaagacagaggttgagcctcattttaataggcattgtggtgggtgttgaatagtgatggaatgtatgggtctggaatcaggctgcctggtcaagggctctgaaacatgagtgtgcatcagaatcacctcgaggcttgttaaaggataggctgtggaccacatctcctcagttgctgattcagtgggtgtgggtggggcctgagaattcacatttcncactggtgatgctgctgttactgattgggaccacatttggngaacactggtctagaattgagaggttggcaaaccttctctgttaagaggtagatagtaaatattttaggccttctgggctacaaagagtatctgttacatattttttattgcttttcatgacccattaagcatatatatatcattctctgccatatacaaacaggctgttgggggagtgaggatgatgtagggaaggtggggcatggtttaataacccctgggccatgcctagatgatcagtcctctgccacatagctggctgacctttgccaagttaatcaccttttacctttattttctcatgtttctaataaaacagagacgataatattcatacttcttaccatatagaacttctgaggattcagtgagcaaagccacaaaagatggtatgtcacaatatctgggatatagctagaatttataatttatttttactctgttgataggcaatgggaaaacagtaagaggcagaccaacagtgatccagggctctgaaagctaattgcttcaagatcctgctaccattttcttttgggccgcttgcaaagaagaatcctttgactgaagcatgtatgtacactctgaagtacagcctgggttagtctcttataagggatcggatcattgctcagctctcccttgagtggcacttagaaaatggcgctattcgtaagctgactggtattgggcccaggactctggctgaaggggtgggcatgctggtaaccatttgcaacctatgctcaggtcctacttgttgggaagccctgattgagaagagtggcctggtctgtgctggcattagataggatctggctgcattaatattgaaactactctgccttttaatgtctcattttgcctcatggtgggagtgaaagtgagaaccacagaaaatctgcctgccaggtgttccacatttcttgtgctacagcatgcaagtgagcagtgaggtgtaccttttcctcatgtagctgggaaagcaatacccctgcttgtacctctggcatatcttctctgtgctggtgcacctagagaggttgcctggtggccctgagagagccatctcatcactaaacactgatggtgaaagctggccatgctcaaataagatgtagcaatctacctcttctttgtctagttacccccaagggggcatccactttcttgctcacctcaccagttgcatgttctagtccttgccagaagcacataataatgactttgtaagcttaagttacaggcacacaaaagggcctgatggtgatatgactccaccctccccgtttttgctgacattccgccaaatatccttctgtctcctccccaccttgcaaaacaaacttcctgttttgaatttggtccaggctggaacagccccacnacacctgttaacacacgcagacgcacacttcccccttcataattgcttagcttcttgttgcctagccagatttcccctcagcttacagttcctgaatcataagatattgaaccagcaaatttaagagttgacattttacttagaggtattcaagtgaaaacatggcttctggtttattttgctgtattgtgccatgaccacttggctaattcttctcctccttcacancagaatggaagtgaggaaaggcaaccagctgacacaggagccagagtgagaccagcagactctcacactcaacctacaccatgaatttgtgtctatcttctacgcgttaagagccaaggacaggtgaagttgccagagagcaatggctctcttcactccgtggaagttgtcctctcagaagctgggctttttcctggtgacttttggcttcatttggggtatgatgcttctgcactttaccatccagcagcgaactcagcctgaaagcagctccatgctgcgcgagcagatcctggacctcagcaaaaggtacatcaaggcactggcagaagaaaacaggaatgtggtggatgggccatacgctggagtcatgacagcttatgatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcagatatcattaacggagctcaagaaaaatgtgtattgcctcctatggacggctaccctcactgtgagggaaagatcaagtggatgaaagacatgtggcgttcagatccctgctacgcagactatggagtggatggatccacctgctctttttttatttacctcagtgaggttgaaaattggtgtcctcatttaccttggagagcaaaaaatccctacgaagaagctgatcataattcattggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagtccttgattcatttggtactgaacccgaatttaatcatgcaaattatgcccaatcgaaaggccacaagaccccttggggaaaatggaatctgaaccctcagcagttttataccatgttccctcataccccagacaacagctttctggggtttgtggttgagcagcacctgaactccagtgatatccaccacattaatgaaatcaaaaggcagaaccagtcccttgtgtatggcaaagtggatagcttctggaagaataagaagatctacttggacattattcacacatacatggaagtgcatgcaactgtttatggctccagcacaaagaatattcccagttacgtgaaaaaccatggtatcctcagtggacgggacctgcagttccttcttcgagaaaccaagttgtttgttggacttgggttcccttacgagggcccagctcccctggaagctatcgcaaatggatgtgcttttctgaatcccaagttcaacccacccaaaagcagcaaaaacacagactttttcattggcaagccaactctgagagagctgacatcccagcatccttacgctgaagttttcatcgggcggccacatgtgtggactgttgacctcaacaatcaggaggaagtagaggatgcagtgaaagcaattttaaatcagaagattgagccatacatgccatatgaatttacgtgcgaggggatgctacagagaatcaatgctttcattgaaaaacaggacttctgccatgggcaagtgatgtggccacccctcagcgccctacaggtcaagcttgctgagcccgggcagtcctgcaagcaggtgtgccaggagagccagctcatctgcgagccttctttcttccagcacctcaacaaggacaaggacatgctgaagtacaaggtgacctgccaaagctcagagctggccaaggacatcctggtgccctcctttgaccctaagaataagcactgtgtgtttcaaggtgacctcctgctcttcagctgtgcaggcgcccaccccaggcaccagagggtctgcccctgccgggacttcatcaagggccaggtggctctctgcaaagactgcctatagcagctacctgctcagccctgcaccatgctgctggggaagacagtggccccagccccgtcaggcagggccagggacagaagtcatgcagggactctggcaagagcctgaactttttcgtagaaggttctgaat

SEQ ID NO: 401819 - DNA, 4114 bp, Homo sapiens
  misc_feature (225)..(225): n is a, c, g, or t
  misc_feature (297)..(297): n is a, c, g, or t
  misc_feature (1002)..(1002): n is a, c, g, or t
  misc_feature (1043)..(1043): n is a, c, g, or t
taatactcctttattccctgttttaaaaatttttttaaatttgatacaataattatacataataatggagtaccatgtgagattcaatccacatatacattgtgaaatgatcaaattaggatagttagcatgcacatcacccccaaataattattacttttgtggtgagaacacttaaaattgtctcttttagaaatatacgttattattaaccatagtcacctngctgtgcaatagaacaccagaacttattcctcctaaatgtaactttttacccattgaccactccctcctcanccccctctctcctccccacccctggtaaccactgttctgttatctcctatgatagcaactttttagcttctgcatgtgagattgtacggtagttgcctttctgtgcctggattatttcatttagcataatgtccttcgggtatatccctgttgctgcaaaagacaggatttctctctctttttctggttgaatagtattccattgtcagagaatgttgtaagactaggaaaggaacactgcaggctggagccctggggaaatggtctgaggcaggtggtgggactagagctggggtctggcaaacaggctgggtttgattgtcagcataatagagagcactcatgtgccagctgggtgggaggagcagccgagtgaagaaggggaagcctctcaggaagcatgtgcagggtttatggtaatgagcagaccagcaggtacgtagtgggagaggggtgtgatggggcagaggaacttacgttatgatagtacaagacagaggttgagcctcattttaataggcattgtggtgggtgttgaatagtgatggaatgtatgggtctggaatcaggctgcctggtcaagggctctgaaacatgagtgtgcatcagaatcacctcgaggcttgttaaaggataggctgtggaccacatctcctcagttgctgattcagtgggtgtgggtggggcctgagaattcacatttcncactggtgatgctgctgttactgattgggaccacatttggngaacactggtctagaattgagaggttggcaaaccttctctgttaagaggtagatagtaaatattttaggccttctgggctacaaagagtatctgttacatattttttattgcttttcatgacccattaagcatatatatatcattctctgccatatacaaacaggctgttgggggagtgaggatgatgtagggaaggtggggcatggtttaataacccctgggccatgcctagatgatcagtcctctgccacatagctggctgacctttgccaagttaatcaccttttacctttattttctcatgtttctaataaaacagagacgataatattcatacttcttaccatatagaacttctgaggattcagtgagcaaagccacaaaagatggtatgtcacaatatctgggatatagctagaatttataatttatttttactctgttgataggcaatgggaaaacagtaagaggcagaccaacagtgatccagggctctgaaagctaattgcttcaagatcctgctaccattttcttttgggccgcttgcaaagaagaatcctttgactgaagcataatggaagtgaggaaaggcaaccagctgacacaggagccagagtgagaccagcagactctcacactcaacctacaccatgaatttgtgtctatcttctacgcgttaagagccaaggacaggtgaagttgccagagagcaatggctctcttcactccgtggaagttgtcctctcagaagctgggctttttcctggtgacttttggcttcatttggggtatgatgcttctgcactttaccatccagcagcgaactcagcctgaaagcagctccatgctgcgcgagcagatcctggacctcagcaaaaggtacatcaaggcactggcagaagaaaacaggaatgtggtggatgggccatacgctggagtcatgacagcttatgatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcagatatcattaacggagctcaagaaaaatgtgtattgcctcctatggacggctaccctcactgtgagggaaagatcaagtggatgaaagacatgtggcgttcagatccctgctacgcagactatggagtggatggatccacctgctctttttttatttacctcagtgaggttgaaaattggtgtcctcatttaccttggagagcaaaaaatccctacgaagaagctgatcataattcattggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagtccttgattcatttggtactgaacccgaatttaatcatgcaaattatgcccaatcgaaaggccacaagaccccttggggaaaatggaatctgaaccctcagcagttttataccatgttccctcataccccagacaacagctttctggggtttgtggttgagcagcacctgaactccagtgatatccaccacattaatgaaatcaaaaggcagaaccagtcccttgtgtatggcaaagtggatagcttctggaagaataagaagatctacttggacattattcacacatacatggaagtgcatgcaactgtttatggctccagcacaaagaatattcccagttacgtgaaaaaccatggtatcctcagtggacgggacctgcagttccttcttcgagaaaccaagttgtttgttggacttgggttcccttacgagggcccagctcccctggaagctatcgcaaatggatgtgcttttctgaatcccaagttcaacccacccaaaagcagcaaaaacacagactttttcattggcaagccaactctgagagagctgacatcccagcatccttacgctgaagttttcatcgggcggccacatgtgtggactgttgacctcaacaatcaggaggaagtagaggatgcagtgaaagcaattttaaatcagaagattgagccatacatgccatatgaatttacgtgcgaggggatgctacagagaatcaatgctttcattgaaaaacaggacttctgccatgggcaagtgatgtggccacccctcagcgccctacaggtcaagcttgctgagcccgggcagtcctgcaagcaggtgtgccaggagagccagctcatctgcgagccttctttcttccagcacctcaacaaggacaaggacatgctgaagtacaaggtgacctgccaaagctcagagctggccaaggacatcctggtgccctcctttgaccctaagaataagcactgtgtgtttcaaggtgacctcctgctcttcagctgtgcaggcgcccaccccaggcaccagagggtctgcccctgccgggacttcatcaagggccaggtggctctctgcaaagactgcctatagcagctacctgctcagccctgcaccatgctgctggggaagacagtggccccagccccgtcaggcagggccagggacagaagtcatgcagggactctggcaagagcctgaactttttcgtagaaggttctgaat

SEQ ID NO: 401820 - DNA, 3433 bp, Homo sapiens
  misc_feature (225)..(225): n is a, c, g, or t
  misc_feature (297)..(297): n is a, c, g, or t
  misc_feature (1002)..(1002): n is a, c, g, or t
  misc_feature (1043)..(1043): n is a, c, g, or t
taatactcctttattccctgttttaaaaatttttttaaatttgatacaataattatacataataatggagtaccatgtgagattcaatccacatatacattgtgaaatgatcaaattaggatagttagcatgcacatcacccccaaataattattacttttgtggtgagaacacttaaaattgtctcttttagaaatatacgttattattaaccatagtcacctngctgtgcaatagaacaccagaacttattcctcctaaatgtaactttttacccattgaccactccctcctcanccccctctctcctccccacccctggtaaccactgttctgttatctcctatgatagcaactttttagcttctgcatgtgagattgtacggtagttgcctttctgtgcctggattatttcatttagcataatgtccttcgggtatatccctgttgctgcaaaagacaggatttctctctctttttctggttgaatagtattccattgtcagagaatgttgtaagactaggaaaggaacactgcaggctggagccctggggaaatggtctgaggcaggtggtgggactagagctggggtctggcaaacaggctgggtttgattgtcagcataatagagagcactcatgtgccagctgggtgggaggagcagccgagtgaagaaggggaagcctctcaggaagcatgtgcagggtttatggtaatgagcagaccagcaggtacgtagtgggagaggggtgtgatggggcagaggaacttacgttatgatagtacaagacagaggttgagcctcattttaataggcattgtggtgggtgttgaatagtgatggaatgtatgggtctggaatcaggctgcctggtcaagggctctgaaacatgagtgtgcatcagaatcacctcgaggcttgttaaaggataggctgtggaccacatctcctcagttgctgattcagtgggtgtgggtggggcctgagaattcacatttcncactggtgatgctgctgttactgattgggaccacatttggngaacactggtctagaattgagaggttggcaaaccttctctgttaagaggtagatagtaaatattttaggccttctgggctacaaagagtatctgttacatattttttattgcttttcatgacccattaagcatatatatatcattctctgccatatacaaacaggctgttgggggagtgaggatgatgtagggaaggtggggcatggtttaataacccctgggccatgcctagatgatcagtcctctgccacatagctggctgacctttgccaagttaatcaccttttacctttattttctcatgtttctaataaaacagagacgataatattcatacttcttaccatatagaacttctgaggattcagtgagcaaagccacaaaagatggtatgtcacaatatctgggatatagctagaatttataatttatttttactctgttgataggcaatgggaaaacagtaagaggcagaccaacagtgatccagggctctgaaagctaattgcttcaagatcctgctaccattttcttttgggccgcttgcaaagaagaatcctttgactgaagcataatggaagtgaggaaaggcaaccagctgacacaggagccagagtgagaccagcagactctcacactcaacctacaccatgaatttgtgtctatcttctacgcgttaagagccaaggacaggtgaagttgccagagagcaatggctctcttcactccgtggaagttgtcctctcagaagctgggctttttcctggtgacttttggcttcatttggggtatgatgcttctgcactttaccatccagcagcgaactcagcctgaaagcagctccatgctgcgcgagcagatcctggacctcagcaaaaggtacatcaaggcactggcagaagaaaacaggaatgtggtggatgggccatacgctggagtcatgacagcttatgatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcagatatcattaacggagctcaagaaaaatgtgtattgcctcctatggacggctaccctcactgtgagggaaagatcaagtggatgaaagacatgtggcgttcagatccctgctacgcagactatggagtggatggatccacctgctctttttttatttacctcagtgaggttgaaaattggtgtcctcatttaccttggagagcaaaaaatccctacgaagaagctgatcataattcattggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagtccttgattcatttggtactgaacccgaatttaatcatgcaaattatgcccaatcgaaaggccacaagaccccttggggaaaatggaatctgaaccctcagcagttttataccatgttccctcataccccagacaacagctttctggggtttgtggttgagcagcacctgaactccagtgatatccaccacattaatgaaatcaaaaggcagaaccagtcccttgtgtatggcaaagtggatagcttctggaagattgagctccttgaggagatgataatggctgacattttagtgcttcctgtgttccaggcatggccttcacaatgactatgaagtaaatactattattaaccccacttttgagtgaaagaactgaagcagatagaggtaaaggttcctcaggtggtcaggatttgaattacatcatgtattgtagccaacacactggactacaaggaatggattctctcttggtaatttcctcctctgtctccaacccatcctctcaaatcccaaaagcctaaataaatacatttatgttggtgtggt

SEQ ID NO: 401821 - DNA, 1727 bp, Homo sapiens
gcagaagcaggaagcagcagaagcaggaagcggcagaagcaggaagcagtatgatgaaaaagcatgaagaattccggtggatgagactacggatccggcgaatggctgacgcatggatccaagcaatcaagtccctggcagaaaagcagaaccttgaaaagagaaagcggaagaaagtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagtccttgattcatttggtactgaacccgaatttaatcatgcaaattatgcccaatcgaaaggccacaagaccccttggggaaaatggaatctgaaccctcagcagttttataccatgttccctcataccccagacaacagctttctggggtttgtggttgagcagcacctgaactccagtgatatccaccacattaatgaaatcaaaaggcagaaccagtcccttgtgtatggcaaagtggatagcttctggaagaataagaagatctacttggacattattcacacatacatggaagtgcatgcaactgtttatggctccagcacaaagaatattcccagttacgtgaaaaaccatggtatcctcagtggacgggacctgcagttccttcttcgagaaaccaagttgtttgttggacttgggttcccttacgagggcccagctcccctggaagctatcgcaaatggatgtgcttttctgaatcccaagttcaacccacccaaaagcagcaaaaacacagactttttcattggcaagccaactctgagagagctgacatcccagcatccttacgctgaagttttcatcgggcggccacatgtgtggactgttgacctcaacaatcaggaggaagtagaggatgcagtgaaagcaattttaaatcagaagattgagccatacatgccatatgaatttacgtgcgaggggatgctacagagaatcaatgctttcattgaaaaacaggacttctgccatgggcaagtgatgtggccacccctcagcgccctacaggtcaagcttgctgagcccgggcagtcctgcaagcaggtgtgccaggagagccagctcatctgcgagccttctttcttccagcacctcaacaaggacaaggacatgctgaagtacaaggtgacctgccaaagctcagagctggccaaggacatcctggtgccctcctttgaccctaagaataagcactgtgtgtttcaaggtgacctcctgctcttcagctgtgcaggcgcccaccccaggcaccagagggtctgcccctgccgggacttcatcaagggccaggtggctctctgcaaagactgcctatagcagctacctgctcagccctgcaccatgctgctggggaagacagtggccccagccccgtcaggcagggccagggacagaagtcatgcagggactctggcaagagcctgaactttttcgtagaaggttctgaat

SEQ ID NO: 401822 - DNA, 412 bp, Homo sapiens
atttgaagtataaccattgctattcttctgagtaattttgcttggaaatgcctatattctgtggggatcatagtttacatatgttttgccttttctagaaagtgtaagatgctttcagtggcgaacaggaggactgtgttcatgcacttccttttggatatttgtcctgtcagtatattagatcacattgtttgctcacgccaataaggttaggaaccgtggatctcagctgagacctgaccagatcctgtggcctcgcattccctcctaccccttagttttcctcctcctccaccccacccaacccccatatgcatagaaccctgggttgctgagtcctgtgcacagccatgagctagtttgtgatgggaaggattcattctgactgaccagacctgggtaacatctacct

SEQ ID NO: 401823 - DNA, 83 bp, Homo sapiens
ctattgggggaagtggggaggttggggaagatcccagagttcctaagtatattaagattaaaatatttccattccttaatact

SEQ ID NO: 401824 - DNA, 286 bp, Homo sapiens
tatttttaaaaatgaatccccccagctgacatgaacataccaaagcatgcatgcacacagtgtttacttttttcagtaatagtatgtgctgggaaaactttacaggaattacagcttatttactgctgcttgaaacagagaaaagccttgtcatgtcttcttagaaaggcaccccttgagatactactgaaattggcttctctgtttcaaaacactcttctgagatgctcagtcccataccccttccttccaatatcctttgttagaagcctgaagtcagtatgtg

SEQ ID NO: 401825 - DNA, 5355 bp, Homo sapiens
  misc_feature (2773)..(2773): n is a, c, g, or t
gcaattaattataggcttgtaattccacatctgaagtcaaagatctattggaacagaaaagcaagttgaccatagaagtggctgaacttcagagacagcttcaactggaagtcaagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagctattccaggtgaagatggaacgggagcagcatcagactgagatcagggatctccaggaccagctctcagaaatgcacgatgaactggacagtgcaaagcgatcggaggacagggagaagggagctctgattgaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaagaatgtcgaggtcttggcgagcaggagcaacacttcagagcaagaccaggcggggactgaaatgcgcgtgaagcttctgcaggaggagaatgagaagctgcagggaagaagcgaagagctggagcggagagttgctcagcttcaaaggcagatcgaggacctgaaaggcgatgaagccaaggcgaaggaaacgctgaagaagtacgagggagaaatacgacagttagaggaggcccttgtgcacgccagaaaggaagaaaaagaagctgtgtcagccagaagggccctggagaatgaactggaggctgctcagggaaatctgagtcagactacccaggagcagaagcagttgtctgagaagctcaaagaggagagtgagcagaaggagcagctaagaaggttgaagaacgagatggagaatgagcggtggcacctgggcaaaaccattgagaaactgcagaaggagatggcagacattgttgaggcctcccgtacctcaaccctggagctccagaaccagctggatgagtataaggagaaaaaccgcagggagctcgcagaaatgcaaagacagttgaaggagaaaacgctggaggcagaaaagtcccgactgacagccatgaaaatgcaggatgagatgcgtctgatggaggaagagttacgggactaccagagagctcaggatgaagcactcacaaaaaggcagcttctggagcagacgctgaaggacctggagtatgagctggaagccaagagtcacctcaaagatgaccgcagcaggctggtcaagcagatggaggacaaggtgtctcaactggagatggaactggaagaagagagaaacaactcagatttgctgtctgagaggatcagtaggagcagggaacagatggagcagttgaggaatgagctacttcaggagagagctgcgagacaagacttggagtgcgacaagatttccctggagaggcagaacaaggacttaaagagccggattatccacctggaaggttcctacaggtccagcaaagaggggctggttgtgcagatggaggccaggatcgcggagctggaggaccgcctggagagtgaggagagggatcgggccaatcttcagctcagcaaccggcggctggagcggaaagtgaaggagctggtgatgcaggtggatgatgagcacctgtcattgactgatcagaaggaccagctgagcttgcgtttgaaagccatgaagcggcaggtggaggaggctgaggaggaaatcgacagactggaaagttctaaaaagaagctgcagagggagctggaggagcagatggacatgaatgagcatctgcaggggcagctcaactccatgaagaaggacttaagactgaagaagctgccgagtaaagtgctggatgacatggatgacgacgatgacctcagcacggatgggggaagcctctatgaggcgcctgtgagctacacattctccaaggacagcaccgtcgccagccagatctgagtgctctcccgggctgtggaagtacctgtcattcctgcaggagctgcagccacccaaagtgggaggcagggaggggagcatctgtctgccactgagaccaatcacagcctctttgcacagcatgccagctcctcagtgttacattcctcgccagggtctctcagtgggtcttcgacagagagcttttgcagtttaaaatgttgggatgcctgaggaccaggagccaccacccactggggtgttgtgagagatacactttggtaggctgaggcccctgttccacagccactatttgcattgctgtccctgccccctcatcactccccctgccaagacaaagggtccagaaggctaggacttacttaatagcactgtgcagggaggaaaccatgtatagcttgtacatattttaaaccagaccttctcacgaactgctgctgttgggtttggaatgtgatggaggcttggtagggtggctggtttgtaaagttcatgcatctatattgagtattctttttttttttttttgagatggagtttcattcttgttgccgaggctggagtgcaatggcgcaaccttggctcactgcaacctctgcctccctggttcaagtgattctcctgcctcatcctcccaagaagctgagattacngatgaccaccaccactcctggctaattttttgtatttagtagagacggggtttcaccatgttggtcaggctggtcttgaactcctgacctcaggtgatccacctgcctcagcctcccaaagtgctgagattacaggcatgagccaccacgcccagccattgagtattcttttttaaaatatgaagctattagattttaagtgttgaggagcagaggtgagaagagagagagagagagaaagtcaaataaagtcaaagaccagtttggaaaccaaagttggaaaagaagaattgtagtggtcatggacagctaagactgagcatagcagttcacatggtctgggtaaacaagtcactggcacaggggaaagccagaaggttgcttgtgtctgtgactgcagctatggccttgtttgcttagtttatctggaattctgttataatttctgaactgttctgagacctgttcccagtcactgattgcaatttcttttacacaggttgggtagggagagttgtaggtaaggccttaaacaaatgaggccgtttctggaaggatagggctgtgtggtcatgtcccacagcaagcttttgggatcgggggaataagagggtatgggggaaaggttcatagacttaggtgtgagaatgaggtgggaggtgtctggtaaggtcatgggggaagggagatgagagaggagataggcagatgtgggtatggggcccagtgtgagaaggaagacagagaagttcttgaaagctgggggatgtgtgggcaagaggtggattgagcaggatctcagggttatgtcgaggaagggaagaaagaaacagaagtcaggcagaggcgtgtctgtgcaaactggaggactccttccaacttcctggaacaaagcgacatcgccagcagcaggctggcagggagtggttgaggtctgggggccaggccacatggctggagaggaatttcagggagcatagcatcgggaggatgctacatatccagggactccctcctggccttcctgtgtcacttcacaatgtgacagtccccaggcatgcccacaggccaggcccagtcacagctgggcttccacaggtcagaatatgggacaggacatggtcagggagaggaccctgtgagttggtgacatatatgtggcagagatggtagtgttcagctgcttcagcagtgtccccaaccatcccaatagggtgggggcctgtgggccagaggactccatgacagtagccatggagtcccacctgtgccaggtcagagcccacccggcaggtttcagagtggtcagcccagtttaagggtgggagtctggagccagacagccaagccccttccacatctacagggtcactgtcatcctcaccacagccaggggtgattctcacctctgcctgcttatgtggggtgtggccgattcctccctttagtcattcattcatttagcacatatttattgggcatcggtgatgtgtcaggcacagtccttggcacacagaatacagcagtgaattaaacaggcaaaaattcctcccctcctggagctcagtgtcaggaaagggggtgataaatgacaatcaaatcgacatggaggttgagcacctctgtactcagccctctgtctgtccttctgaggacgcaacaagcctggttccctagagctcactttgaccctcaatatgttcataatttccctgctgcttctcccatcgttagacatctgccagtaagcctgctgagagaagcctcagcccactcatacctagagacgctgctggggaaggtcagcacacccaagaactttgggagtgtgtgtctgttttggtttgtgagaaagtagctgcccctcattctggccagttctttccagtagccatggggctggctacaagaagcaaaactgcccatgcaaagagaacacaggtcacttttcaaaacacttgcatcattaccctaaaaataggctgttatgcgttttgacaattgcgctatcctacactctgagggagttggcaacgcatgcggtatagtggagtgggaagagttgagactgaaagttaagagaagggttttcaagtcccggctcatctcaccccagtgaccttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtgagtgaattcctggataaagcaagatttcctttcaataaacgctgtcacccaatgggaaaaaaaact

SEQ ID NO: 401826 - DNA, 501 bp, Homo sapiens
catgatacgaatcgagctcgtgacccattcgcgaatgaccttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtgagtgaattcctggataaagcaagatttcctttcaataaacgctgtcacccaatgggaaaaaaaact

SEQ ID NO: 401827 - DNA, 5265 bp, Homo sapiens
  misc_feature (2683)..(2683): n is a, c, g, or t
tttaaaatcacactgattcctgttagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagctattccaggtgaagatggaacgggagcagcatcagactgagatcagggatctccaggaccagctctcagaaatgcacgatgaactggacagtgcaaagcgatcggaggacagggagaagggagctctgattgaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaagaatgtcgaggtcttggcgagcaggagcaacacttcagagcaagaccaggcggggactgaaatgcgcgtgaagcttctgcaggaggagaatgagaagctgcagggaagaagcgaagagctggagcggagagttgctcagcttcaaaggcagatcgaggacctgaaaggcgatgaagccaaggcgaaggaaacgctgaagaagtacgagggagaaatacgacagttagaggaggcccttgtgcacgccagaaaggaagaaaaagaagctgtgtcagccagaagggccctggagaatgaactggaggctgctcagggaaatctgagtcagactacccaggagcagaagcagttgtctgagaagctcaaagaggagagtgagcagaaggagcagctaagaaggttgaagaacgagatggagaatgagcggtggcacctgggcaaaaccattgagaaactgcagaaggagatggcagacattgttgaggcctcccgtacctcaaccctggagctccagaaccagctggatgagtataaggagaaaaaccgcagggagctcgcagaaatgcaaagacagttgaaggagaaaacgctggaggcagaaaagtcccgactgacagccatgaaaatgcaggatgagatgcgtctgatggaggaagagttacgggactaccagagagctcaggatgaagcactcacaaaaaggcagcttctggagcagacgctgaaggacctggagtatgagctggaagccaagagtcacctcaaagatgaccgcagcaggctggtcaagcagatggaggacaaggtgtctcaactggagatggaactggaagaagagagaaacaactcagatttgctgtctgagaggatcagtaggagcagggaacagatggagcagttgaggaatgagctacttcaggagagagctgcgagacaagacttggagtgcgacaagatttccctggagaggcagaacaaggacttaaagagccggattatccacctggaaggttcctacaggtccagcaaagaggggctggttgtgcagatggaggccaggatcgcggagctggaggaccgcctggagagtgaggagagggatcgggccaatcttcagctcagcaaccggcggctggagcggaaagtgaaggagctggtgatgcaggtggatgatgagcacctgtcattgactgatcagaaggaccagctgagcttgcgtttgaaagccatgaagcggcaggtggaggaggctgaggaggaaatcgacagactggaaagttctaaaaagaagctgcagagggagctggaggagcagatggacatgaatgagcatctgcaggggcagctcaactccatgaagaaggacttaagactgaagaagctgccgagtaaagtgctggatgacatggatgacgacgatgacctcagcacggatgggggaagcctctatgaggcgcctgtgagctacacattctccaaggacagcaccgtcgccagccagatctgagtgctctcccgggctgtggaagtacctgtcattcctgcaggagctgcagccacccaaagtgggaggcagggaggggagcatctgtctgccactgagaccaatcacagcctctttgcacagcatgccagctcctcagtgttacattcctcgccagggtctctcagtgggtcttcgacagagagcttttgcagtttaaaatgttgggatgcctgaggaccaggagccaccacccactggggtgttgtgagagatacactttggtaggctgaggcccctgttccacagccactatttgcattgctgtccctgccccctcatcactccccctgccaagacaaagggtccagaaggctaggacttacttaatagcactgtgcagggaggaaaccatgtatagcttgtacatattttaaaccagaccttctcacgaactgctgctgttgggtttggaatgtgatggaggcttggtagggtggctggtttgtaaagttcatgcatctatattgagtattctttttttttttttttgagatggagtttcattcttgttgccgaggctggagtgcaatggcgcaaccttggctcactgcaacctctgcctccctggttcaagtgattctcctgcctcatcctcccaagaagctgagattacngatgaccaccaccactcctggctaattttttgtatttagtagagacggggtttcaccatgttggtcaggctggtcttgaactcctgacctcaggtgatccacctgcctcagcctcccaaagtgctgagattacaggcatgagccaccacgcccagccattgagtattcttttttaaaatatgaagctattagattttaagtgttgaggagcagaggtgagaagagagagagagagagaaagtcaaataaagtcaaagaccagtttggaaaccaaagttggaaaagaagaattgtagtggtcatggacagctaagactgagcatagcagttcacatggtctgggtaaacaagtcactggcacaggggaaagccagaaggttgcttgtgtctgtgactgcagctatggccttgtttgcttagtttatctggaattctgttataatttctgaactgttctgagacctgttcccagtcactgattgcaatttcttttacacaggttgggtagggagagttgtaggtaaggccttaaacaaatgaggccgtttctggaaggatagggctgtgtggtcatgtcccacagcaagcttttgggatcgggggaataagagggtatgggggaaaggttcatagacttaggtgtgagaatgaggtgggaggtgtctggtaaggtcatgggggaagggagatgagagaggagataggcagatgtgggtatggggcccagtgtgagaaggaagacagagaagttcttgaaagctgggggatgtgtgggcaagaggtggattgagcaggatctcagggttatgtcgaggaagggaagaaagaaacagaagtcaggcagaggcgtgtctgtgcaaactggaggactccttccaacttcctggaacaaagcgacatcgccagcagcaggctggcagggagtggttgaggtctgggggccaggccacatggctggagaggaatttcagggagcatagcatcgggaggatgctacatatccagggactccctcctggccttcctgtgtcacttcacaatgtgacagtccccaggcatgcccacaggccaggcccagtcacagctgggcttccacaggtcagaatatgggacaggacatggtcagggagaggaccctgtgagttggtgacatatatgtggcagagatggtagtgttcagctgcttcagcagtgtccccaaccatcccaatagggtgggggcctgtgggccagaggactccatgacagtagccatggagtcccacctgtgccaggtcagagcccacccggcaggtttcagagtggtcagcccagtttaagggtgggagtctggagccagacagccaagccccttccacatctacagggtcactgtcatcctcaccacagccaggggtgattctcacctctgcctgcttatgtggggtgtggccgattcctccctttagtcattcattcatttagcacatatttattgggcatcggtgatgtgtcaggcacagtccttggcacacagaatacagcagtgaattaaacaggcaaaaattcctcccctcctggagctcagtgtcaggaaagggggtgataaatgacaatcaaatcgacatggaggttgagcacctctgtactcagccctctgtctgtccttctgaggacgcaacaagcctggttccctagagctcactttgaccctcaatatgttcataatttccctgctgcttctcccatcgttagacatctgccagtaagcctgctgagagaagcctcagcccactcatacctagagacgctgctggggaaggtcagcacacccaagaactttgggagtgtgtgtctgttttggtttgtgagaaagtagctgcccctcattctggccagttctttccagtagccatggggctggctacaagaagcaaaactgcccatgcaaagagaacacaggtcacttttcaaaacacttgcatcattaccctaaaaataggctgttatgcgttttgacaattgcgctatcctacactctgagggagttggcaacgcatgcggtatagtggagtgggaagagttgagactgaaagttaagagaagggttttcaagtcccggctcatctcaccccagtgaccttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtgagtgaattcctggataaagcaagatttcctttcaataaacgctgtcacccaatgggaaaaaaaact

SEQ ID NO: 401828 - DNA, 4673 bp, Homo sapiens
  misc_feature (2683)..(2683): n is a, c, g, or t
tttaaaatcacactgattcctgttagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagctattccaggtgaagatggaacgggagcagcatcagactgagatcagggatctccaggaccagctctcagaaatgcacgatgaactggacagtgcaaagcgatcggaggacagggagaagggagctctgattgaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaagaatgtcgaggtcttggcgagcaggagcaacacttcagagcaagaccaggcggggactgaaatgcgcgtgaagcttctgcaggaggagaatgagaagctgcagggaagaagcgaagagctggagcggagagttgctcagcttcaaaggcagatcgaggacctgaaaggcgatgaagccaaggcgaaggaaacgctgaagaagtacgagggagaaatacgacagttagaggaggcccttgtgcacgccagaaaggaagaaaaagaagctgtgtcagccagaagggccctggagaatgaactggaggctgctcagggaaatctgagtcagactacccaggagcagaagcagttgtctgagaagctcaaagaggagagtgagcagaaggagcagctaagaaggttgaagaacgagatggagaatgagcggtggcacctgggcaaaaccattgagaaactgcagaaggagatggcagacattgttgaggcctcccgtacctcaaccctggagctccagaaccagctggatgagtataaggagaaaaaccgcagggagctcgcagaaatgcaaagacagttgaaggagaaaacgctggaggcagaaaagtcccgactgacagccatgaaaatgcaggatgagatgcgtctgatggaggaagagttacgggactaccagagagctcaggatgaagcactcacaaaaaggcagcttctggagcagacgctgaaggacctggagtatgagctggaagccaagagtcacctcaaagatgaccgcagcaggctggtcaagcagatggaggacaaggtgtctcaactggagatggaactggaagaagagagaaacaactcagatttgctgtctgagaggatcagtaggagcagggaacagatggagcagttgaggaatgagctacttcaggagagagctgcgagacaagacttggagtgcgacaagatttccctggagaggcagaacaaggacttaaagagccggattatccacctggaaggttcctacaggtccagcaaagaggggctggttgtgcagatggaggccaggatcgcggagctggaggaccgcctggagagtgaggagagggatcgggccaatcttcagctcagcaaccggcggctggagcggaaagtgaaggagctggtgatgcaggtggatgatgagcacctgtcattgactgatcagaaggaccagctgagcttgcgtttgaaagccatgaagcggcaggtggaggaggctgaggaggaaatcgacagactggaaagttctaaaaagaagctgcagagggagctggaggagcagatggacatgaatgagcatctgcaggggcagctcaactccatgaagaaggacttaagactgaagaagctgccgagtaaagtgctggatgacatggatgacgacgatgacctcagcacggatgggggaagcctctatgaggcgcctgtgagctacacattctccaaggacagcaccgtcgccagccagatctgagtgctctcccgggctgtggaagtacctgtcattcctgcaggagctgcagccacccaaagtgggaggcagggaggggagcatctgtctgccactgagaccaatcacagcctctttgcacagcatgccagctcctcagtgttacattcctcgccagggtctctcagtgggtcttcgacagagagcttttgcagtttaaaatgttgggatgcctgaggaccaggagccaccacccactggggtgttgtgagagatacactttggtaggctgaggcccctgttccacagccactatttgcattgctgtccctgccccctcatcactccccctgccaagacaaagggtccagaaggctaggacttacttaatagcactgtgcagggaggaaaccatgtatagcttgtacatattttaaaccagaccttctcacgaactgctgctgttgggtttggaatgtgatggaggcttggtagggtggctggtttgtaaagttcatgcatctatattgagtattctttttttttttttttgagatggagtttcattcttgttgccgaggctggagtgcaatggcgcaaccttggctcactgcaacctctgcctccctggttcaagtgattctcctgcctcatcctcccaagaagctgagattacngatgaccaccaccactcctggctaattttttgtatttagtagagacggggtttcaccatgttggtcaggctggtcttgaactcctgacctcaggtgatccacctgcctcagcctcccaaagtgctgagattacaggcatgagccaccacgcccagccattgagtattcttttttaaaatatgaagctattagattttaagtgttgaggagcagaggtgagaagagagagagagagagaaagtcaaataaagtcaaagaccagtttggaaaccaaagttggaaaagaagaattgtagtggtcatggacagctaagactgagcatagcagttcacatggtctgggtaaacaagtcactggcacaggggaaagccagaaggttgcttgtgtctgtgactgcagctatggccttgtttgcttagtttatctggaattctgttataatttctgaactgttctgagacctgttcccagtcactgattgcaatttcttttacacaggttgggtagggagagttgtaggtaaggccttaaacaaatgaggccgtttctggaaggatagggctgtgtggtcatgtcccacagcaagcttttgggatcgggggaataagagggtatgggggaaaggttcatagacttaggtgtgagaatgaggtgggaggtgtctggtaaggtcatgggggaagggagatgagagaggagataggcagatgtgggtatggggcccagtgtgagaaggaagacagagaagttcttgaaagctgggggatgtgtgggcaagaggtggattgagcaggatctcagggttatgtcgaggaagggaagaaagaaacagaagtcaggcagaggcgtgtctgtgcaaactggaggactccttccaacttcctggaacaaagcgacatcgccagcagcaggctggcagggagtggttgaggtctgggggccaggccacatggctggagaggaatttcagggagcatagcatcgggaggatgctacatatccagggactccctcctggccttcctgtgtcacttcacaatgtgacagtccccaggcatgcccacaggccaggcccagtcacagctgggcttccacaggtcagaatatgggacaggacatggtcagggagaggaccctgtgagttggtgacatatatgtggcagagatggtagtgttcagctgcttcagcagtgtccccaaccatcccaatagggtgggggcctgtgggccagaggactccatgacagtagccatggagtcccacctgtgccaggtcagagcccacccggcaggtttcagagtggtcagcccagtttaagggtgggagtctggagccagacagccaagccccttccacatctacagggtcactgtcatcctcaccacagccaggggtgattctcacctctgcctgcttatgtggggtgtggccgattcctccctttagtcattcattcatttagcacatatttattgggcatcggtgatgtgtcaggcacagtccttggcacacagaatacagcagtgaattaaacaggcaaaaattcctcccctcctggagctcagtgtcaggaaagggggtgataaatgacaatcaaatcgacatggaggttgagcacctctgtactcagccctctgtctgtccttctgaggacgcaacaagcctggttccctagagctcactttgaccctcaatatgttcataatttccctgctgcttctcccatcgttagacatctgccagtaagcctgctgagagaagcctcagcccactcatacctagagacgctgctggggaaggtcagcacacccaagaactttgggagtgtgtgtctgttttggtttgtgagaaagtagctgcccctcattctggccagttctttccagtagccatggggctggctacaagaagcaaaactgcccatgcaaagagaacacaggtcacttttcaaaacacttgcatccagagacacttgcatccagaggtgg

SEQ ID NO: 401829 - DNA, 3926 bp, Homo sapiens
  misc_feature (2683)..(2683): n is a, c, g, or t
tttaaaatcacactgattcctgttagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagctattccaggtgaagatggaacgggagcagcatcagactgagatcagggatctccaggaccagctctcagaaatgcacgatgaactggacagtgcaaagcgatcggaggacagggagaagggagctctgattgaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaagaatgtcgaggtcttggcgagcaggagcaacacttcagagcaagaccaggcggggactgaaatgcgcgtgaagcttctgcaggaggagaatgagaagctgcagggaagaagcgaagagctggagcggagagttgctcagcttcaaaggcagatcgaggacctgaaaggcgatgaagccaaggcgaaggaaacgctgaagaagtacgagggagaaatacgacagttagaggaggcccttgtgcacgccagaaaggaagaaaaagaagctgtgtcagccagaagggccctggagaatgaactggaggctgctcagggaaatctgagtcagactacccaggagcagaagcagttgtctgagaagctcaaagaggagagtgagcagaaggagcagctaagaaggttgaagaacgagatggagaatgagcggtggcacctgggcaaaaccattgagaaactgcagaaggagatggcagacattgttgaggcctcccgtacctcaaccctggagctccagaaccagctggatgagtataaggagaaaaaccgcagggagctcgcagaaatgcaaagacagttgaaggagaaaacgctggaggcagaaaagtcccgactgacagccatgaaaatgcaggatgagatgcgtctgatggaggaagagttacgggactaccagagagctcaggatgaagcactcacaaaaaggcagcttctggagcagacgctgaaggacctggagtatgagctggaagccaagagtcacctcaaagatgaccgcagcaggctggtcaagcagatggaggacaaggtgtctcaactggagatggaactggaagaagagagaaacaactcagatttgctgtctgagaggatcagtaggagcagggaacagatggagcagttgaggaatgagctacttcaggagagagctgcgagacaagacttggagtgcgacaagatttccctggagaggcagaacaaggacttaaagagccggattatccacctggaaggttcctacaggtccagcaaagaggggctggttgtgcagatggaggccaggatcgcggagctggaggaccgcctggagagtgaggagagggatcgggccaatcttcagctcagcaaccggcggctggagcggaaagtgaaggagctggtgatgcaggtggatgatgagcacctgtcattgactgatcagaaggaccagctgagcttgcgtttgaaagccatgaagcggcaggtggaggaggctgaggaggaaatcgacagactggaaagttctaaaaagaagctgcagagggagctggaggagcagatggacatgaatgagcatctgcaggggcagctcaactccatgaagaaggacttaagactgaagaagctgccgagtaaagtgctggatgacatggatgacgacgatgacctcagcacggatgggggaagcctctatgaggcgcctgtgagctacacattctccaaggacagcaccgtcgccagccagatctgagtgctctcccgggctgtggaagtacctgtcattcctgcaggagctgcagccacccaaagtgggaggcagggaggggagcatctgtctgccactgagaccaatcacagcctctttgcacagcatgccagctcctcagtgttacattcctcgccagggtctctcagtgggtcttcgacagagagcttttgcagtttaaaatgttgggatgcctgaggaccaggagccaccacccactggggtgttgtgagagatacactttggtaggctgaggcccctgttccacagccactatttgcattgctgtccctgccccctcatcactccccctgccaagacaaagggtccagaaggctaggacttacttaatagcactgtgcagggaggaaaccatgtatagcttgtacatattttaaaccagaccttctcacgaactgctgctgttgggtttggaatgtgatggaggcttggtagggtggctggtttgtaaagttcatgcatctatattgagtattctttttttttttttttgagatggagtttcattcttgttgccgaggctggagtgcaatggcgcaaccttggctcactgcaacctctgcctccctggttcaagtgattctcctgcctcatcctcccaagaagctgagattacngatgaccaccaccactcctggctaattttttgtatttagtagagacggggtttcaccatgttggtcaggctggtcttgaactcctgacctcaggtgatccacctgcctcagcctcccaaagtgctgagattacaggcatgagccaccacgcccagccattgagtattcttttttaaaatatgaagctattagattttaagtgttgaggagcagaggtgagaagagagagagagagagaaagtcaaataaagtcaaagaccagtttggaaaccaaagttggaaaagaagaattgtagtggtcatggacagctaagactgagcatagcagttcacatggtctgggtaaacaagtcactggcacaggggaaagccagaaggttgcttgtgtctgtgactgcagctatggccttgtttgcttagtttatctggaattctgttataatttctgaactgttctgagacctgttcccagtcactgattgcaatttcttttacacaggttgggtagggagagttgtaggtaaggccttaaacaaatgaggccgtttctggaaggatagggctgtgtggtcatgtcccacagcaagcttttgggatcgggggaataagagggtatgggggaaaggttcatagacttaggtgtgagaatgaggtgggaggtgtctggtaaggtcatgggggaagggagatgagagaggagataggcagatgtgggtatggggcccagtgtgagaaggaagacagagaagttcttgaaagctgggggatgtgtgggcaagaggtggattgagcaggatctcagggttatgtcgaggaagggaagaaagaaacagaagtcaggcagaggcgtgtctgtgcaaactggaggactccttccaacttcctggaacaaagcgacatcgccagcagcaggctggcagggagtggttgaggtctgggggccaggccacatggctggagaggaatttcagggagcatagcatcgggaggatgctacatatccagggactccctcctggccttcctgtgtcacttcacaatgtgacagtccccaggcatgcccacaggccaggcccagtcacagctgggcttccacaggtcagaatatgggacaggacatggtcagggagaggaccctgtgagttggtgacatatatgtggcagctacctccatgtgagtgaattcctggataaagcaagatttcctttcaataaacgctgtcacccaatgggaaaaaaaact

SEQ ID NO: 401830 - DNA, 628 bp, Homo sapiens
ttgagatggagtcttgctctgttgcccaggctggagtgcagtggcgcgatctcagctcactgcaagcaagctttgcctcctgggttgacgccattctcctgcctcagcttcctgagaagctgggacaacaggcgcccgccaccatgcccagctaatttttttgtatatttagtagagacggggtttcaccatgttagtcaggatggtctcgatctcctgacctcgtgatctgcccgcctcggcctctcaaagtgctggggattacaagcatgagccaccgtgcccagctggtttttattttcttattgtttgcctattttaacctttcctaaaatgaaaatatatttttaaaaaatcattttatttagaaaaattaaattagtgcccctcaagtctgatttaatgatattagactagcctttcccacagctgttctaaccgtagaaccttgaagtttagtagaaaactacaatgttacaaatttcatcatgtgtaaatataacctaaatcatcttagaattgtgatgaccagaacgatttctatttgagatgcaatcctagtctcagaaacagacttcaaccaacaaaataattatttctcaagagtaaacccttaactagaaaaacc

SEQ ID NO: 401831 - DNA, 214 bp, Homo sapiens
tgaggagagtgagatactgggggctgattggctttgttgcctccggatagtattcctagactaaagaaggaccttgaagggtgggtggcaatgtttagaggatataaatcagaaagtgtctgagacaagtctcaatttagagatttattttgccaaggttgaggatgctctggggaaaaagagacacaagccaaagtaggatctgtagcctgta

SEQ ID NO: 401832 - DNA, 3136 bp, Homo sapiens
gcgcatgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttggtaaccccatttatcagatgctagaattaaagctagccatgtacattgatttccccttaaatatgaatcctggaattctggttacctgtgcagatgatattgaactttatagtattggagaatttgagtttattaggtttgacaaacctggctttactgctttagctcatccttctagtttgacgataggtaccacacatggagtatttgtcttagatccttttgatgatttaaaacatagagaccttgaatacaggtcttgccatcgtttccttcataagcccagcatagaaaagatgtatcagtttaatgctgtgtgtagacctggaaatttttgtcaacaggactttgctgggggtgacattgccgatcttaaattagactctgactatgtctacacagatagcctattttatatggatcataaatcagcaaaaatgttacttgctttttatgaaaaaataggcacactgagctgtgaaatagatgcctatggtgactttctgcaggctttgggacctggagcaactgtggagtacaccagaaacacatcaaatgtcattaaagaagagtcagagttggtagaaatgaggcagagaatatttcatcttcttaaaggaacatcactaaatgttgttgttcttaataactccaaattttatcacattggaacaaccgaagaatatttgttttactttacctcagataacagtttaaagtcagagctcggcttacagtccataacttttagtatctttccagatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagaggtattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctcaactgtaattctatttttaataataaaaatggcatactgtagggtcttcagagtagtgtaggaatactgtagaaatactttttcagaaacgaatccatagctgacaaattcactcagtgcccaatatattgtgattattttcgttgataaagaactagatacaaagacctctgaaattgatgataaaatttgtatctcattaattttatcaaaatgaaactaaaagtacatatgtattatacacttgaacatgtgtttgtatatctttaaaattttcctttatgttccattccataggaaaacacacatatgcacacaaaactcagttatctgtggggaaagtggtagtaataattgagattcatcaataatcatataatttcactatagacattacttgcattatctcctatcagtccttctaacaaaacttaaattaccagatgaactgactttagttttcatcttattttttgtccacatgctggtgatgctgagaaacaataattggcccaaatgcagacatcaagaagcaggcaggaaaatggaaaaactgagataatacacaggtgataaacagtttcaagaaaataaaaattggctagaatctcaagttatgtgtttctatattggtataagcatataagtgaaaagtcttataagtgtaatagagaaaagatttgtcagtgtgtttttttaaatgaaataactagtctgtgctactttatgtcaatataaaaattggtaaactagaagtaacttgtccacaaccctcagttatgatacttatgtgcgtgtttttttttccaaagtttttcccaaggagaagatacaaatatatggtagctattgtttaaaaatgattgatttacttgcagatttttcagaggatgttatgtctttgtcattcattaaatgttcaaaattgtagtttt

SEQ ID NO: 401833 - DNA, 1233 bp, Homo sapiens
gcgcatgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttgggtaatggattggtgacaggaagaaatgaagaaaaagagaaggcaggaggagaaagaaagacagaaagggcaccttagagtaccattgtctgattatatcctcctctgtgctgcctctaatctttatcaacataacagcacttactacatggtgttgtttttatccatttataggtctatctccccactagtatatgtgttcattaaaggcagctttttttcttatttagccttatttatatttgtacttatttgtaaaacaaactaataacttagggcttaccatatgccagaaatgcttctacgtatctttttgtgcatcagcttatataatcctaatggtgtatatgtaaagtgctttagcacagtgtctggcacatggcaaaccctcaaaaatgttagttaacacttaatcattattgtttatgttaacaaccctctgaagtaagtgttgcaattgccatgttatacctggagaaaatgaggctaatcaaattaaactggcttgaactagattaaacaatttgtatgatttacctaggattgcatccatctttatttgatttcaaaatgtatcatattcataatcttggttatgaatattatacaacctttttgaaaaaactatggaagtgatggctctccacatgtgacttcaaatgttttcaattaaattattttgtttcaatagtttttatcataataaattttaagactatgttttgctaaacattgtcaa

SEQ ID NO: 401834 - DNA, 3239 bp, Homo sapiens
gcgcatgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttggtaaccccatttatcagatgctagaattaaagctagccatgtacattgatttccccttaaatatgaatcctggaattctggttacctgtgcagatgatattgaactttatagtattggagaatttgagtttattaggtttgacaaacctggctttactgctttagctcatccttctagtttgacgataggtaccacacatggagtatttgtcttagatccttttgatgatttaaaacatagagaccttgaatacaggtcttgccatcgtttccttcataagcccagcatagaaaagatgtatcagtttaatgctgtgtgtagacctggaaatttttgtcaacaggactttgctgggggtgacattgccgatcttaaattagactctgactatgtctacacagatagcctattttatatggatcataaatcagcaaaaatgttacttgctttttatgaaaaaataggcacactgagctgtgaaatagatgcctatggtgactttctgcaggctttgggacctggagcaactgtggagtacaccagaaacacatcaaatgtcattaaagaagagtcagagttggtagaaatgaggcagagaatatttcatcttcttaaaggaacatcactaaatgttgttgttcttaataactccaaattttatcacattggaacaaccgaagaatatttgttttactttacctcagataacagtttaaagtcagagctcggcttacagtccataacttttagtatctttccagatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagaggtattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctcaactgtaattctatttttaataataaaaatggcatactgtagggtcttcagagtagtgtaggaatactgtagaaatactttttcagaaacgaatccatagctgacaaattcactcagtgcccaatatattgtgattattttcgttgataaagaactagatacaaagacctctgaaattgatgataaaatttgtatctcattaattttatcaaaatgaaactaaaagtacatatgtattatacacttgaacatgtgtttgtatatctttaaaattttcctttatgttccattccataggaaaacacacatatgcacacaaaactcagttatctgtggggaaagtggtagtaataattgagattcatcaataatcatataatttcactatagacattacttgcattatctcctatcagtccttctaacaaaacttaaattaccagatgaactgactttagttttcatcttattttttgtccacatgctggtgatgctgagaaacaataattggcccaaatgcagacatcaagaagcaggcaggaaaatggaaaaactgagataatacacaggtgataaacagtttcaagaaaataaaaattggctagaatctcaagttatgtgtttctatattggtataagcatataagtgaaaagtcttataagtgtaatagagaaaagatttgtcagtgtgtttttttaaatgaaataactagtctgtgctactttatgtcaatataaaaattggtaaactagaagtaacttgtccacaaccctcagttatgatacttatgtgcgtgtttttttttccaaagtttttcccaaggagaagatacaaatatatggtagctattgtttaaaaatgattgatttacttgcagatttttcagaggatgttatgtctttgtcattcattaaatgttcaaaattgtagttttaccaaatctgaagtgccatcagttataagaatcaccattattttatgttccattaagaaaaacacaataaaacatgacactgctttttttgttacttgaaatt

SEQ ID NO: 401835 - DNA, 3185 bp, Homo sapiens
gcgcatgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtggatcctgctggagccaaaattggaaatggaggatcaacactttgtgcccttcaatgtttggaaaagctatatggagataaatggaattcttttaccatcttattaattcactctggtggctacagtcaacgacttccaaatgcaagtgctctgggaaaaattttcactgctttacctcttggtaaccccatttatcagatgctagaattaaagctagccatgtacattgatttccccttaaatatgaatcctggaattctggttacctgtgcagatgatattgaactttatagtattggagaatttgagtttattaggtttgacaaacctggctttactgctttagctcatccttctagtttgacgataggtaccacacatggagtatttgtcttagatccttttgatgatttaaaacatagagaccttgaatacaggtcttgccatcgtttccttcataagcccagcatagaaaagatgtatcagtttaatgctgtgtgtagacctggaaatttttgtcaacaggactttgctgggggtgacattgccgatcttaaattagactctgactatgtctacacagatagcctattttatatggatcataaatcagcaaaaatgttacttgctttttatgaaaaaataggcacactgagctgtgaaatagatgcctatggtgactttctgcaggctttgggacctggagcaactgtggagtacaccagaaacacatcaaatgtcattaaagaagagtcagagttggtagaaatgaggcagagaatatttcatcttcttaaaggaacatcactaaatgttgttgttcttaataactccaaattttatcacattggaacaaccgaagaatatttgttttactttacctcagataacagtttaaagtcagagctcggcttacagtccataacttttagtatctttccagatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagaggtattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagatttgtggagcattgttttttcacataattagttttaaaggtaattttctaagcatacctttggaatttttccatcttttttgaggcttttggtccagtgaagttctaagtattcactggcacttctctcctcaactgtaattctatttttaataataaaaatggcatactgtagggtcttcagagtagtgtaggaatactgtagaaatactttttcagaaacgaatccatagctgacaaattcactcagtgcccaatatattgtgattattttcgttgataaagaactagatacaaagacctctgaaattgatgataaaatttgtatctcattaattttatcaaaatgaaactaaaagtacatatgtattatacacttgaacatgtgtttgtatatctttaaaattttcctttatgttccattccataggaaaacacacatatgcacacaaaactcagttatctgtggggaaagtggtagtaataattgagattcatcaataatcatataatttcactatagacattacttgcattatctcctatcagtccttctaacaaaacttaaattaccagatgaactgactttagttttcatcttattttttgtccacatgctggtgatgctgagaaacaataattggcccaaatgcagacatcaagaagcaggcaggaaaatggaaaaactgagataatacacaggtgataaacagtttcaagaaaataaaaattggctagaatctcaagttatgtgtttctatattggtataagcatataagtgaaaagtcttataagtgtaatagagaaaagatttgtcagtgtgtttttttaaatgaaataactagtctgtgctactttatgtcaatataaaaattggtaaactagaagtaacttgtccacaaccctcagttatgatacttatgtgcgtgtttttttttccaaagtttttcccaaggagaagatacaaatatatggtagctattgtttaaaaatgattgatttacttgcagatttttcagaggatgttatgtctttgtcattcattaaatgttcaaaattgtagttttaccaaatctgaagtgccatcagttataagaatcaccattattttatgttccattaagaaaaacacaataaaacatgacactgctttttttgttacttgaaatt

SEQ ID NO: 401836 - DNA, 488 bp, Homo sapiens
aggaagcatgtacgcagatccaattaaatcactaggtcactctaaatcactaggccatttttaggtcatttatggggcttggaaatatacaatcattaaaaaataacttttccacaaataaagggcaagcttgtgaaggcagaaaagagaaaccgtataactggaattaaccttgaagggtataaaaaaaatttacttttaaatgtgagaaatttctaggagatccaatatatgtatcaaaatttcactttggaattatgatctaacaaatcacttaatacctttctgaattacagatagtccacataaaacccaaggtactataataactaagtacattacttcaatctgtactttatataaatgacttggctttatcctcagtgctaaaagaaacaagtcaatccatttctttgtgttctgataacataaatgatgcaggaaaaaaatatgaatcaggctttctgaagaaaaggtatgagtctacc

SEQ ID NO: 401837 - DNA, 523 bp, Homo sapiens
gaagatatgcaggaaataaaatttttaggaaataaaatattctttacaatgtatcttaaaacaacaaaatgaacaatgaagatgtataaactggctgtgcatttacttaacttaaaggatatcagaattaatatattacaaaaaaaattcattcttaaaagcaaagtataattgtttgccacaattattttaatatatttctttcccaggataaattttaaactcaggaaagcaaggactggaattggaagggttaaaaaaacacgaagcaacagtaactccatttagataaggggatagaagggtggagcaagggaacaatacactaaagtacttttctttcacagatcttggttcaaattaaggttaaattccaaaggaggatgtgttttccccatatggagtcttaaaggacatgcctttgtttccagcttcccagagaagatatatgttaacacaaacaagcatttcataataaatttaacttttatagagtgactaatgccctcctgcaataaggcgg

SEQ ID NO: 401838 - DNA, 117 bp, Homo sapiens
ggggaagaccaacaaagcaagataaagagcttgctgttgtgttagagcctcgagtgggcttccagcagggtgaggcttttctacctggcgttatacaggaagttcaaggtaaagtca

SEQ ID NO: 401839 - DNA, 251 bp, Homo sapiens
aatgttgatggccgccaccctcatgacatcatagatgatatcaacagtggttctgtggaatgcccagccagttaagcacaaaggaaaatatttcaataaaggatcatttgacaactggtggaaaaaaaaaaaagtagttcaatagtgcttcaaaggatatttcaagaaatttaaatccagagaatggaagaaatatttgcaaatctgataaggatctagtaaccagattatataaataacttataatgcaa

SEQ ID NO: 401840 - DNA, 346 bp, Homo sapiens
cacagactgggtaatttgtaaagaaaagaaatgtatttttcatagttctggatgctgggaagtccattatcaaggtatcggcatcttgagagggcctctttgctgctgtatcatcctatggtggaagggtaggagagcacacagcaagaggcgcagaggggccaaacttgcttttgtaacaaagccactctctaacccagtcccgcaataatgacattaatctattcatggcggcagaaccctcttgatctaatcacctcttaaaggttctacttctcaacatggttgcattgaaggttaagtttccagcacatgaactttgggggacacgttcaggccataatag

SEQ ID NO: 401841 - DNA, 4387 bp, Homo sapiens
cctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggctggaagcgcaattcattgaccccgaggacaactgttttcccttgccctggctgtgagcatgatgtggatcttggagaacgaggaatcaatggtctgtttcgaaacttcactttggaaactattgtggacagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtaaatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatcatgtagacatttttaaatgtgaagctttaacaggaataggatagctgtttcaaaccttgtgcaattgtaaataaattgtttagctgtgtttctttcatttttaataaaaaattaaaaag

SEQ ID NO: 401842 - DNA, 1274 bp, Homo sapiens
cctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggcttcagcaatgggcctgcagcaaacccatgagcattcccggttgacttctaaaggtggagaggcccgctgtccctttgaaatctctgaggttggaaagcagtctctcccaagaagaacttaggacaattcctctctctgttttgtgggggttggagggggagagttggtctggagtaggctcctaaccatttcaacgtaagcttatttcctaccactctcctcaggctcaaatcctgccccgccccgcagccccagcactagcccatttaagacccctgttttgtgtgtgattatacaggatttgaacactgaatattaaccatggaatagcagacctttgagactgacttgctttattttcctctgtggggttcggttccactttgtagttcgggtttgtaatgtaaagaataatgggaaactggtctaattatgagagttaagagagtagaggcctgtagttggcctgccctccgccccaccatccctcaaagttgagaccactgagttaaccatcctcttaatttctctcacttttcccccagatttgtttcatccttgtactggacttctcaagctctgtacataattaaaaatacatagctttacatttttacaaacttaatacctggaatatatgcttgttgtaaagtattcaaacttcacagaaaggttcacagagtaaaaagtctaagttcatgcccacctccaatctcattccttccccagtggcagcagtttgtgtgtc

SEQ ID NO: 401843 - DNA, 645 bp, Homo sapiens
cctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaagatgccggattggagacgaggctaccgctgcagacagggctgtgggaagacgacggaacttgccacagcgacagacttctcccaaacaggaaataaaagtgggaagcattttaaaacctaaa

SEQ ID NO: 401844 - DNA, 785 bp, Homo sapiens
ggcacgcgatgtttccaacagcatgtgctcacgttcaggtatctgtcgcattctggatagttctcccaatattctgaacttttcttaagcgtgtatttgtgttatagcgatctcaatcagtgatctttgatgttactagtgtttaggaggcaccatgaactatgcccatataatatagtgaacttaatggatacatgtgtatgttctgactgctccacacatctgctgtttccttttctctctcctcaggccttcctatttcgtgaaacagcaacactgaaattaaaccaatcactagcccatttaagacccctgttttgtgtgtgattatacaggatttgaacactgaatattaaccatggaatagcagacctttgagactgacttgctttattttcctctgtggggttcggttccactttgtagttcgggtttgtaatgtaaagaataatgggaaactggtctaattatgagagttaagagagtagaggcctgtagttggcctgccctccgccccaccatccctcaaagttgagaccactgagttaaccatcctcttaatttctctcacttttcccccagatttgtttcatccttgtactggacttctcaagctctgtacataattaaaaatacatagctttacatttttacaaacttaatacctggaatatatgcttgttgtaaagtattcaaacttcacagaaaggttcacagagtaaaaagtctaagttcatgcccacctccaatctcattccttccccagtggcagcagtttgtgtgtc

SEQ ID NO: 401845 - DNA, 4203 bp, Homo sapiens
ttcccaggcggagtccgcaggagccgctgctgcagccggcagctgggcgggattcccggggtagtcgctgggagcaaagctcgcttctcccgcgcctgtgcttttgcctgccccggcttacttctccccgcgtcggtccgctggccacgtacagctgaccagctcatcttccagcttcggaccgaggctccacggccgccgcagggacccgcccaccagaccctgcgctcggtagccggtgtgagtggaacgtgccgctgatgacacctggcagaaggcagccatggagggcgatggctcagattcgccggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccagcatcacaacggagatctgtggggtggagaggctggaagcgcaattcattgaccccgaggacaactgttttcccttgccctggctgtgagcatgatgtggatcttggagaacgaggaatcaatggtctgtttcgaaacttcactttggaaactattgtggacagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtaaatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatcatgtagacatttttaaatgtgaagctttaacaggaataggatagctgtttcaaaccttgtgcaattgtaaataaattgtttagctgtgtttctttcatttttaataaaaaattaaaaag

SEQ ID NO: 401846 - DNA, 3938 bp, Homo sapiens
ttcccaggcggagtccgcaggagccgctgctgcagccggcagctgggcgggattcccggggtagtcgctgggagcaaagctcgcttctcccgcgcctgtgcttttgcctgccccggcttacttctccccgcgtcggtccgctggccacgtacagctgaccagctcatcttccagcttcggaccgaggctccacggccgccgcagggacccgcccaccagaccctgcgctcggtagccggtgtgagtggaacgtgccgctgatgacacctggcagaaggcagccatggagggcgatggctcagattcgccggctggaagcgcaattcattgaccccgaggacaactgttttcccttgccctggctgtgagcatgatgtggatcttggagaacgaggaatcaatggtctgtttcgaaacttcactttggaaactattgtggacagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtaaatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatcatgtagacatttttaaatgtgaagctttaacaggaataggatagctgtttcaaaccttgtgcaattgtaaataaattgtttagctgtgtttctttcatttttaataaaaaattaaaaag

SEQ ID NO: 401847 - DNA, 704 bp, Homo sapiens
ggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggtaagtgatgaggcgcggggcgccgcggcctgggcccccgactccggcactacctggcccgccactgtgggcgtccgtgtccattccagcgcctgggaagggcgggaggctggaatccaggagccgcgctcgcagcccgggcgtcccagcagctgcggaatgcaaagtagccgccttttctttattgcgtggcatctctgaaataagccaagaggggactttcggacgcttttggggccagctgggcagcaataggggctctcggacgccgaagggcgagagcccagcgtcggaagatggagaggagggcggggcgttggccaagggggcgctgcccc

SEQ ID NO: 401848 - DNA, 723 bp, Homo sapiens
cctgccggcatgcgataaaggccggggaatgtctagctggggccgcgctgagccgagtgcggacccgctttgtgtgcgcgtttgtttgtctccgctgcggtccgaaccgctgccgcgacccccgaggaggcggggcctccgcgcgcccggctccgcctggtgagggtttcacggcctctgctgccgccgccgccgccctcgtttgttccgttagatcgcgcagccccgaccgctgcacccggatcctagcaagccgggcgaggctgcccgggagccctcgatggccttcatttcacccaagcccgcttcttgctttccccggcgcttcccctcttttcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaagatgccggattggagacgaggctaccgctgcagacagggctgtgggaagacgacggaacttgccacagcgacagacttctcccaaacaggaaataaaagtgggaagcattttaaaacctaaaaaaaaaacaaacacatcaaaccacaacaccaccgccaccaagcccaccaccgcagaccagcccaccaccagagagggg

SEQ ID NO: 401849 - DNA, 4173 bp, Homo sapiens
ttcccaggcggagtccgcaggagccgctgctgcagccggcagctgggcgggattcccggggtagtcgctgggagcaaagctcgcttctcccgcgcctgtgcttttgcctgccccggcttacttctccccgcgtcggtccgctggccacgtacagctgaccagctcatcttccagcttcggaccgaggctccacggccgccgcagggacccgcccaccagaccctgcgctcggtagccggtgtgagtggaacgtgccgctgatgacacctggcagaaggcagccatggagggcgatggctcagattcgccggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggctggaagcgcaattcattgaccccgaggacaactgttttcccttgccctggctgtgagcatgatgtggatcttggagaacgaggaatcaatggtctgtttcgaaacttcactttggaaactattgtggacagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtaaatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatcatgtagacatttttaaatgtgaagctttaacaggaataggatagctgtttcaaaccttgtgcaattgtaaataaattgtttagctgtgtttctttcatttttaataaaaaattaaaaag

SEQ ID NO: 401850 - DNA, 4205 bp, Homo sapiens
agcggagtttaaatccattgtttctggccgggtatggtggcccggcactttgggaggccaaggtgggaggatcacctgaggtcaggagttcgagaccagcctggacaacatggttgtcagcgaagtgaaggaaagccggcagtcacaggcctcacccagctcccacacagtccaaagggccagtcccacttccactgtacccccaacaacagtaccaagtttgtttccaggcagtgggtgagcagggctgagaacttgccccagtctacccgcctcccagctgcaaaagcaagtatggctttccttctcccacctgtggagtctgcacactggatttacaccctcccccaagttgtggccaggaggcttctccatcagttcaaattgttacaaactttagctggaggtttccttctccctgtggccttttcccagagcctctggccgttctccggaaggacccctgtgaggccaggcaaaaacgacttgatgggggcccagtgagcttccaggggttttcccactgcttcctctacccttgtatttcactcagctctctaaattgactcagctccaggctggaagcgcaattcattgaccccgaggacaactgttttcccttgccctggctgtgagcatgatgtggatcttggagaacgaggaatcaatggtctgtttcgaaacttcactttggaaactattgtggacagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtaaatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatcatgtagacatttttaaatgtgaagctttaacaggaataggatagctgtttcaaaccttgtgcaattgtaaataaattgtttagctgtgtttctttcatttttaataaaaaattaaaaag

SEQ ID NO: 401851 - DNA, 3740 bp, Homo sapiens
agcggagtttaaatccattgtttctggccgggtatggtggcccggcactttgggaggccaaggtgggaggatcacctgaggtcaggagttcgagaccagcctggacaacatggctggaagcgcaattcattgaccccgaggacaactgttttcccttgccctggctgtgagcatgatgtggatcttggagaacgaggaatcaatggtctgtttcgaaacttcactttggaaactattgtggacagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggaaaagctttcaaaggatattgattaccttattggtaaggaaagccaggtgaagagtcaaatatctgaactaaacttgttaatgaaagaaacagagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcagaatacagaaagccacagaatctttgaagagctttagacctgcagctcagacttcttttgaagactatgttgttaatacctctaaacaaacagaacttcttggagaattatcctttttctctagtggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtaaatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatcatgtagacatttttaaatgtgaagctttaacaggaataggatagctgtttcaaaccttgtgcaattgtaaataaattgtttagctgtgtttctttcatttttaataaaaaattaaaaag

SEQ ID NO: 401852 - DNA, 454 bp, Homo sapiens
atcacactctttatgagcctctcctttgttcccagagaccctgaatgggtccagccactcccctcactaagagcctgggcgcaactttggtggaggtgataagtgccatggtaaaggtacactgtgcagagtgagttagggtgagaccacccaccttgggaagggggccacggtgagaaagccatggatctagaccaggagtacaagaattttagaatggagagagcccttagaggccagctaatgcatcacttatccagctcaaagacttgcaagatgcagggccagatgcggtggctcacgcctataatcccagcagtttgagatgctgaagcaggcagatcacttgagaccaggagttcaagaccagcctggccaacatggcaaaaccccatctctactaaaaaatacaaaaattagccaggtgtggtggcacacacctgtaatcccaggt

SEQ ID NO: 401853 - DNA, 516 bp, Homo sapiens
tctagaggatcccatatcggtggagaggtgggcagatcacttgagcccaggagtttgagagcagtctggccaacatggtgaaaccccatctccactaaaaatacaaaaattagccaggcgtggtggtggtgcctgtaatcccagctactcgggaggttgaggcaggagaatcacttgaacccgggagttggaggttgcagtgagctgagatcacaccactgcactccagcctgagcaacagagcgagactccgtctcaagaaaaaaaaaaaaagaattttgcactctcagctctaagcacacttaatactctcaacaacctgtgatacagatataatattattacattgattttacagaggaggaaactgaggcttaaggaggttaagaaaatcttccaagttcgtcacataggtagtcggttgggcagctcagattcaatgccaggtccacctgactttaaagcccatgaccttaacaattatgccttattaatttccttttgcagatattcact

SEQ ID NO: 401854 - DNA, 381 bp, Homo sapiens
cactagcttgacctggaatccgcatgaatcatccacattggccagctagcccatccccaggggaccctgtaattgtgcaaccagcctctcccctctacccaccctccttctcttgataaaacctggccagaaactcaggcatagagagaaaatggatgcggtgacaattccatgtgttattcagaattaactaggtgaatatcgctgagctcctcttaggtagtaggcattgaacgatgcagagatctcggggaaatgggccttatcctcagggaccctgcagccctctggttccagtgtcagcagccctcactaaatgtcaatggatgcgcccagaagaggagctaggacttcataggacgagacaggttctctagcgcc

SEQ ID NO: 401855 - DNA, 534 bp, Homo sapiens
aatttggcatcattattttatctggcaatctcagtcaggtttaacacctttcccaagctgagcttgtcatttcctccaaaagaacacaaacctataaaggacaggtaacgtcctgtgggacagccatcctttgccctatgctgagaaaacaggtttgcagagaataaaaacgaacaaataaataaacatttaaaaaagcagttgtgtggaaagaagcacaaaagagaggccatgagactccataattaagcagagatgaactgccctagttcttaatggcttgttagtcctcattccagtcttccacagggtgtgacttggcttccataaaataaactcacggtcccatgatcattttccctctttgctttagcaagaatctttaactaaaacaactctcttttcatttccactgtctaccactctagtctcaactctcatgagtctggaattttgcaaaagcctgataaacttgtcacatgattccagtgtctacccattccttgtaagtaaccaagatattcttgcctgatt

SEQ ID NO: 401856 - DNA, 162 bp, Homo sapiens
acccacccaccttgggcttccaaagtactggaattacaggcatgtgccaccctgccgggccctagttttctatttaaaatccccaatgaaggttaaacaaaatgagaggcttaaatcttttgggggataagttgattatctccctggtttactaatttctta

SEQ ID NO: 401857 - DNA, 1105 bp, Homo sapiens
  misc_feature (6)..(6): n is a, c, g, or t
ggcatnatcctcaacacaataaaccaaagcttcagggttaacggaagacatgatgcagagcaagcctctgtgattcctgcccagcacctgtgaggcctgacgtgtcagttcccaataaatgctcttctgatatgtttcccgtacaggcaaggaggcttgggtagtgcagatttgtgtatttcaatctttgaaagctctgatgtaatttagaaatgaaatccaatcatgagtccaggcagagaacgcctgctgtaatctacactgttgctgggactgcgcattctgtatataactgtgttgggtgttgggctatcgcccaacaccttaaaccccccgagcacacaaagcagtgagaagtagttatcttcctggttctttctagttgcctaataacatagttggcttgctctggtctcaagtcaatttggaaacagagagagaatcaagagaatcaaatcaggggacgaagcaaaacaaaagtgaatagcaaacaataagcacatgaaaaatgtgcaacattagccatgggggaaaattcaaatcaaaaccgcaattagataccacttcacacctaccaggatggctagaatcaaaaggacttacaataacaagtgttggggatgatgtggagaaattggaacccttacatactactggtgggaatgtaaaatgttgcagcctaaatgtggaaagcagcctggccattccaccaaaggtcagagttgtcaaatgatccagcagttccactcacaggtatgtatactcaagagaaatataaacatgtccatgcaaaaacttgcacacagatgttcacagagcattattcataatagcaaaaaagtgaaaacaacccaaatgtccatcaaccgataaacaatacgtggtatatccatataatgatatatattcagctataaaaaggaatgaagtattgatacatgtacaacacagatgaaccttgacaatattatgctaagtgagagaagccagtcacatattatatgaatctagttatatgcaatgtccagattgggcaaatccatagagacaaaaagtataatagattagtggttgcttagacatgagggggatggggagatgaagg

SEQ ID NO: 401858 - DNA, 416 bp, Homo sapiens
gcctctcaggcacctcaaatactacctgtccaaacttaagctcattgtcatctccctaaaacctgctcctttttatttcccgtaggttagtgacatcattatacactcaagccagaaatctctccaactttttcatgctactcattcaagcaaccagacatcaggttccactactatcttcttcagaaaagctttccagatcaaagcagaagcccaactctcttctgctgcgtttcaacagggactgcttacgtccagatcatcccagaggattcctgtgttagctctatcagttctaccttccttgagaactgctacatagctaccattcaataaaataaatctcagcgtataaccttacttctcgacacttccacaaatgtcttagtaccgtggggttagggtgcataacctga

SEQ ID NO: 401859 - DNA, 433 bp, Homo sapiens
aacttgtccatgactgtagtgcccattttgctgaagtcttcctcccttgctggctttgaggaagctagctgcaatgttgaggaactccatgtggcacgaaactacaggtggtttccagaagctgagaacagactctagccaacatcctatgaaggtctccagccagcaccctgcaataaagagaatccctcacttctgcgattgcaaggaactgaattctgccagcagtctgaatgagcttggaagtggatacttccttctgttgagcctcagttgagactgaagctctggctgacaccttgattgtgagaccccacctaagtcaagcctggactcctgattcacagaaactggtagataatgaatgtatactgctttataccactaagattgtggtaaggttagacagcaataaataactaatacacagttt

SEQ ID NO: 401860 - DNA, 772 bp, Homo sapiens
cacttagcagctcaaaagacttaaaaaacaaaacagaaaacctagtgactcatgtcacgctttgtagatactttactaagtagacttggaatgctctatttaactgtcaatgcgttgttgcattgaggattttgggggtggtgaaaccagaagcttttccaagatcccatgaccaaaataaactattttcctttttattaaaaaatgggaaaagagagagtattttcctaaaactggcttaaaaagattcagtccacgaacttagtctaggtaaaataataatcatatgcttccccaaactgaaacatttttaatgctttggtttctttaacttttttaaaaactcagaacaagatgatcacttagaaatatgaaattgaaattcgcatgggactccagtaaaacatctttgcaaactgcgtagcacattgaagacagtgcatcagatgtattatatgtaacatgatagaccagccaaaatggacaatgaatagatatttttatttcgatcaactgaactgcatattacaaggtgaaaaaagaaaactccgattacttaagactggttcacaaagcaccttataaattggatactggtcctgatctgtagggatttccccctgggcccattctctttctaatccagattattctctaagaaaaagttaactgaattaaattaattgattcttctgcagtgccgctaaatggtctcaactgcagatgagccaaatacaggtcttttctcaccaggcctgcactccgacccctg

SEQ ID NO: 401861 - DNA, 394 bp, Homo sapiens
gctttcagaactggatgtaaaaccttagcctccttattgcaagagagcacaaatgaagttaaatgtaagcatgtttgaatctgatacaatttattttataatcgcatgctgagaagttaacccagacaataggggataagcttaagttgaaatcgattcttctaaaaatagatcctttttcatttgcattcaccaaaagtgcactcctccatttattaactattttattagtaaataaagtactgtatttaagtgcatatgttagtcagatgggaacaataactttttggagctcaaagcatgttctcttattcagcattatggcctatttgactaagatgtaccttgaattaattaatgcatgatttcagtaataaaaattttaaaagtaata

SEQ ID NO: 401862 - DNA, 819 bp, Homo sapiens
gggctccagccttgggaggacccctttcctgtttcttaaccatgcttgatggtgtcctcaaaggagccctgctcagtggcagaactgctttctcagcctcttccccgccaaggttgttttcaagtcccagcagtcacagactttcatcctgggctcttctttcttttgcaattcagctctcgaaatgactctgtggtctgcgggtgactccactccacgtgcctacagccacgcccacagcgccacctccggacgctgctgagctgcgcacctgtgcctgacacctggctttgggaaactcagcagcagtgcccagcgtcatgaccctgggggcaggagggcatctggatccaggatggcaccctcaccacaatctgtcttggctctgtgcccgcccgtggggtacacaggagggctctttcagccctaagtccttgtgttcctgacctttgttcctcttccacccagcttgcaagtgcagaatttttttttagctcgtcgcttccctgcagtcccttgtccaatgcagcctccggccgatactcaggccagtgttgtttcccaacctctccactagatacgcacacttagctcacggtctgcctcatgagtcatcccagttgagctttaccaaatgttttgccccacctaacagcctgcccacattccaaatcctggcaggtcgcacgttttattagcacagcacccctctcctagcggccagcttctctattaggccacgttatgctccagccacacaactatgaagcgcagacgtctcacacaacaaagctttctcatgctgcaggcccacctcag

SEQ ID NO: 401863 - DNA, 136 bp, Homo sapiens
tgtctttctcctttgggaacttgcaggttgctaggtggagtggggacggtgatgagggtgaggagctggcagtagccccctcacatgggctttgcattactaactctcccttcttgttcccacagaacactctgct

SEQ ID NO: 401864 - DNA, 261 bp, Homo sapiens
cagaactggagttgtattcacattttttattgccactccaactattagattctagagttcctttccctgggaaagctagggtctggtgcagtctttcctgtccatcaggaagcaggattttgatttgtttatttgttttctcattcatttcagtggatttagctcagcttaataaagttcaagtaacctgtccaaaatcataaattagcattagtggttcaagattactgatttcctcagggttctgccagaatttatagc

SEQ ID NO: 401865 - DNA, 1187 bp, Homo sapiens
atcacggtttacttgcccatttcccttttgctaccttctttcctatctggagattcatattctagagtccctggtcaaccctacggatgcgaagaagagatggcagttcacagcaactgcatagagtagggagcagctttcctcccaccatcctaggctggggaccttctttgcttctcacaccactgtggttggctcagctcaagtaagcacgttctctctgtatgctagagctactgacatcatctctactagaattgttttaaatatcttttgatgggaaataccaggttgaacttcaagcatcatggaaacaaaggttctagctgcaagagagtaaagttctaggtgtttgtatgccaaggtttatatgtacacagatccaacacatactgtaagaaagacttgagtacacaaggttttcaggttttaatgcccattgggaccgtgaacaaatgagaagaatgggagcattgtcttgcctcgcttggaaggacgccttccggcatctgatccacatggattcacttttaggatgcagttctttgggggccagatttggctgcagattcaccctgaagagaactatccaatgggcctggtggggcttgggtgcctgccttttttgttggaggctcagacttctagagcagagcaaagttgggaagaatgaggtcttaggattctcattccccagagagccccagcctcgcttctgatcattactccccaagtctgaatctactgtgaaggtgaagttatcaattttttcttgtttgagtcctttaaacccacaaatgtatatgctttattttatattatttattatgtacatatgcctgttagtacttcgtctgtgactaggacaaggtctgtcttgaagcttcctcatccatggatcctagggttctgctgtcctttaaggcgggtgagagggtagtgttgttttttataaacaggttgctgcttttatgttggccctagcatccccagcccctttagttgggcccacctgtattccttatgaccagtgttttggatgaggatggaggcaggtctcctaccttgtgggcagggcctctcaagtacctccatgaaatatttccaaggtggtttcttggtgacaggctctcttcccttcttgaggctccagtccctgtggctgttccttcccatacctcctctct

SEQ ID NO: 401866 - DNA, 361 bp, Homo sapiens
tgtctttttatcttaaatgctttattggctgttgtctgttgccaccacgagaccctaagtttcatgagcaaaaggacttggactgtcttgtctatcacaatatcctcggttcctaaaaggggcctaaattcagggctgaatgaataaatgaatgaatggaagtgcctttcccaaaagacaggaaactaaaccgttttgaaatacagtcaccccagtccaaggtcttctaaactttcctgataagagtcatccgaggtacttatttaaaaaacatatattcccagcccttctgaatcagattctcctacaaaggggcctgggaagcttcaagcttgatgagcaccccaggggatttgtatct

SEQ ID NO: 401867 - DNA, 335 bp, Homo sapiens
aagggtcatggggcacatcctggctgcctttaaaaggaagatgctcaaaagctaccctaggccaggcacagtgcctcacacctgtaatcccaacactttgggaggccaaggcgggaggactgcttgagcccaggagtactagaccaggctgggctttggtgacactccttctctacaaaaactacaaaaatagctgggtgtagtggcacaggcctgtagtcccagctactcaggaggctgaggtggaaggaattgcttaagcccaggagattgaggctgcagtgagctgttaccacgccattagactatagcctgggcaacagagtgagatctca

SEQ ID NO: 401868 - DNA, 138 bp, Homo sapiens
aaaagtcggggaggggagtggaaagattgcttacaaacctgtgcaaaatgcctctgcagatagaatattgtttactctgggagaacaagaaagtctagtagcctgaattgacttacaaagttaaaagcaatctggtaa

SEQ ID NO: 401869 - DNA, 395 bp, Homo sapiens
aaagcaatgggatgtcaattctgtgagtatgtaaaattgtaacttccatcttgcaagccaactctcttctttgctggctttcatgacgcaatataccatgttggaggggctcgcgtggcgaagaactgagaggcctgtaggaacaaagtccaatagccaggtaggaaggagtccctcagtcccacaacccaaggaaactgaattctgtcaactaacacgcatgtaagtgagcttggaagtgacttcttccccaagtgagtcttcagatgaggtcctagccaactttttgattgcagcttgtgacagaccctgaagcaaaggactcagctaagttgtgtcctaattcctccactgtgagaaaataaatgtgtgttttttaaaatgctaaatttgtg

SEQ ID NO: 401870 - DNA, 276 bp, Homo sapiens
tttttagcttggataactgggtaaatgctaatgaccctatctgacataaggaatacagagagaaaaccaggggatgacagcaggttcaatgtaagacatgtcatatgcaaggtttctgcgagacagagagctttgtttacgcaagcaatagcaaatatgggtctgtgactcagtttaagctggagacacagatatttcagaggagaggcaagccaagaagactagaggtgatcagccctaccctgcatcctatttataaagcagcagtgtcactcc

SEQ ID NO: 401871 - DNA, 505 bp, Homo sapiens
ggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggag

SEQ ID NO: 401872 - DNA, 296 bp, Homo sapiens
acaatgtctcttctccattaagaaaacctacttcaacatctccattggttctcaacatagaggaggaaaataatcatatttcatcacagtatttaagtaaggatcaaagactctaagataactgaaagcactaaattaattttcttcaccaagatcacaggaaaaacagaaactacaaggagaaatggaaaaagctggaccttccctatggacatggggaaaagtggctatctggaagtcaagggaaaagagagatttttctttataaaataaaagaaatgcctgaaccaccaaac

SEQ ID NO: 401873 - DNA, 653 bp, Homo sapiens
cagagttttgccatgttgcccaggctggtcttgaactcctgacctcaggtgatccacccgcctcggcctcccaaagcactgggattgcaggcataagccactgtgcctggctgctcgaattattttctaatgtatcagtcatgttgcaacaaattcacatttatagactaagcctttcaacagaactcatttgtcttgaaatttggtcattgccttctatttacattgatttagatgctagattagtcatttatttattgaataagtcacgtattctttggttcacttgagcagtcaaattaggatgtttggaacattgacaggtgtggtgttatggtaaaaacaccagacttaaaattaagatctagtttaaatcctagctttgcaatttcagttttgtcatcttaaggaaagatttctgagtttttaacataatctgttttagctacaaaagtatctcaacaggattgtagatattctgtaactttatcatgtgatgtttaaagctgttgtagattaggtaatatataaatgtaagattttgtacattatttcatcagtcatctgggcccaaggctagatatctggaaaaaatgtatggatggacttaattttattgatacttaagctgcctctactgatgcttttctagg

SEQ ID NO: 401874 - DNA, 430 bp, Homo sapiens
ctatagccccctattgccaacaaaattaaagcctttctcttcattggcattagaagcccctgtaacccattgcttttccatttccagcctctttccaaaattaccaaacaaactctgtatcctgcagccaccaaactgtactagttgtaatatattcactaagaacagtggtctctcatttgtctctcttttctctcttcttatatcagttagaatgtaacagacaacccagctaacacagaggctcatttttcttatgtgacaagaagtctgtagataaagagttgctagtgttttcttgggggttcagtgatatcacctctgtgattcagttgaccttcatatcatagttgcaaaatggctgccgtaagtacaaaaaccacactgactgctgggtgggaaggcaacagaaaatttgttcttggtgagt

SEQ ID NO: 401875 - DNA, 443 bp, Homo sapiens
aggccatgaccagtatggagtgggcaggatgatcgctcccctcattctgcacatcagacttctggcggtgtagccagggtccaggcattctatctccgtgcccatctccatctttcagggtggtcctggagttctctccatatagccctgttgacctcagtggtctgcaaggccctccaggcaggggccttgtcttatatgctcagcgcccagcacaccataggtgcttcatgatagaccctgcaacgaatgcctcaattcctcttgttggcttttcatgtcccacggagtcactctaaactgactgtgccctgagccctgtgtgtgtcacctgtgcctactcccatcctggaatgcccagccagactttgacccacaagagtgcccgggtctctgcaccggcttctgtggggcggttttccccgaaggagaagaagggctcc

SEQ ID NO: 401876 - DNA, 411 bp, Homo sapiens
gcaaaaccttattagaaaaaaaagaaagagaaaaattagccgggcatggcggtgcgtgcctgtagtcccagctactagggagactaaggtgggagagtcgcttgagcctgggaggttgaggctgcagtgagctgtgatactacaacctgagcatcagagtgagaccgtgtcttaaaacaaacaaacaaaaaacataggtacagtgatgttaaggcagtgtgaattaacgttgcatatacttagctctgtaatgaacagtgagtttattaaatagccaattaacccaactattctaaagcaggtactacagattgaagctttgaagttctatgactttgacttttattaaggaaatgcagagctgaggctaacatctctttttttttctaataaagtgagggatcctgctag

SEQ ID NO: 401877 - DNA, 777 bp, Homo sapiens
gcgagaagtcggccggcagtggggccgccttcttttcttcctcctgcttggacgactgtcttccgcctcaactgtggagcctcgccgaccgttagtcctcacagacacctcaggggcaaccgacgcagcgccacctcatcgtgtccgccatcttggggcgacggccagaagtccagggctaggagcctcagccggcggacgccaggaaacaggtctaggttaatagcaggtaattgtgacaagtccagtgtgggttactggtcatgaagaatccattgttgatgacatcccagaagagaacactaagtcttagctttcatcttacccctgaacttcccttcctctgaagcactcattaggtgaataaacaatattccctatacctatagagtggaataccacccagcatcctctcacatacaaagaaagaacaaattgctgatagacacagatgtccatcaatctcaaaagtcgtcatgaaacctctggaagaattgagctggtcgactatgcaaacagttgtcaagagcctataaaatatgcagcataaaatttttcctttgtagtcaaacctgattattcctcttagatactgggaacagaatttcacagtcgtcagagaatataccttttgtatcttcgtattaaatatgtactcctattacttaacaattgtagtttaactccttttttaggtaaaattctaatttttctcttctgttaaaaatttccagttcaacacgaagataataaagaatattaattttatccttatta

SEQ ID NO: 401878 - DNA, 1190 bp, Homo sapiens
gcgagaagtcggccggcagtggggccgccttcttttcttcctcctgcttggacgactgtcttccgcctcaactgtggagcctcgccgaccgttagtcctcacagacacctcaggggcaaccgacgcagcgccacctcatcgtgtccgccatcttggggcgacggccagaagtccagggctaggagcctcagccggcggacgccaggaaacagcagttactgatgctacaatattcctttatgaagccaagaactgaaccaaaatacaaacaacataaactaccacttgatgagaagaacttcaaagtcaaattgcaaaaggtgactaaaaaaggagagtactttcagccgttttcaaaataatctatgatatgtactggaaaacttctaataatccttgtcattttacaactttcccacagttagatcatcagcaaatgtcacttggatccctagctaaattgttcttcccagaaaatagttatctccactatggaaagtattttatcagaagaattcgtagaagtagaatctgtttgtcttcagttaaacaaaagaagaacctcattgctttccaactgggccccggccattttccagttgaaacatcaaatattttatttgtgtctttcactgccaattaaagggcaacagaaatggtacaggctccctctgcagtggaattacccttatgtcttttctgtctatgctgatccacctgatcttgaactggtgctattccatggggaaaattggaacatggggcaattaacactttctccactttatcccatcaacaggaaattgaaatataaccaactaactcaggagacatcatggaagatgtcacacagtgaatgatgatgaagcagaatttttaaaatgtgtaggattacgagaagtggggtcatttttctttgtgtatggtattgctgatgcagtttaatgctccattacttctaaattttcatcataagctagattttccagttgtggtttctataaagaaaaacaaacattctgaagacagtttttccagatttattccagatatcgatgattaacttttgaagctcctctgttgatttgaacatccgctgaagcttatttttcacctcagaatagcatcaacattatttgaaattcaattgtactttctcgttacattaataaatcatggaagttgagaaa

SEQ ID NO: 401879 - DNA, 1020 bp, Homo sapiens
gcgagaagtcggccggcagtggggccgccttcttttcttcctcctgcttggacgactgtcttccgcctcaactgtggagcctcgccgaccgttagtcctcacagacacctcaggggcaaccgacgcagcgccacctcatcgtgtccgccatcttggggcgacggccagaagtccagggctaggagcctcagccggcggacgccaggaaacagcactcattaggtgaataaacaatattccctatacctatagagtggaataccacccagcatcctctcacatacaaagaaagaacaaattgctgatagacacagatgtccatcaatctcaaaagtcgtcatggaggcctacatgcctaccaccagtgctgccatcatgtctctagtcatccctgagaagttccagcatattttgcgagtactcaataccaacatcaatggggggtggaaaacagcctctgccatcactatctttaaggatgtaggtcaaaggagtgaagcctagagctatatttcttcgacacaactgccaacagcattttgggttagatttccatattaagaagcatgtaatatttggaaggcagaagagaaggaaataccatcagcctccaaagagaacagaatgattttgatcagcatgtaggcatcttcatgcacatcatctatttgatgctactactagccaatgagattatgaggttattttctgatatttctgcagcatactgatatttagaagtcagtacaatgttctccacctttggcttccccattcttcaagggattctgtaagccttgaattccctattaactactgtttctgcctcctatacataggaaaatatctgtgttcttgtctgaacctcaaggacaatgcatgtatgaattcccaaattacattggtggctgttgttgttttgagcttcagaaaaggatattaaactcaaaattgtcctatgtgacttgctttttcaccaacaccatatgcctattatttatctatggtattttacatata

SEQ ID NO: 401880 - DNA, 1114 bp, Homo sapiens
gcgagaagtcggccggcagtggggccgccttcttttcttcctcctgcttggacgactgtcttccgcctcaactgtggagcctcgccgaccgttagtcctcacagacacctcaggggcaaccgacgcagcgccacctcatcgtgtccgccatcttggggcgacggccagaagtccagggctaggagcctcagccggcggacgccaggaaacagcagttactgatgctacaatattcctttatgaagccaagaactgaaccaaaatacaaacaacataaactaccacttgatgagaagaacttcaaagtcaaattgcaaaaggtgactaaaaaaggagagtactttcagccgttttcaaaataatctatgatatgtactggaaaacttctaataatccttgtcattttacaactttcccacagttagatcatcagcaaatgtcacttggatccctagctaaattgttcttcccagaaaatagttatctccactatggaaagtattttatcagaagaattcgtagaagtagaatctgtttgtcttcagttaaacaaaagaagaacctcattgctttccaactgggccccggccattttccagttgaaacatcaaatattttatttgtgtctttcactgccaattaaagggcaacagaaatggtacaggctccctctgcagtggaattacccttatgtcttttctgtctatgctgatccacctgatcttgaactggtgctattccatggggaaaattggaacatggggcaattaacactttctccactttatcccatcaacaggaaattgaaatataaccaactaactcaggagacatcatggaagatgtcacacagtgaatgatgatgaagcagaatttttaaaatgtgtaggattacgagaagtggattttccagttgtggtttctataaagaaaaacaaacattctgaagacagtttttccagatttattccagatatcgatgattaacttttgaagctcctctgttgatttgaacatccgctgaagcttatttttcacctcagaatagcatcaacattatttgaaattcaattgtactttctcgttacattaataaatcatggaagttgagaaa

SEQ ID NO: 401881 - DNA, 379 bp, Homo sapiens
ccaacttgcaggaattcacagctctttagttttagatttctctgcctcccatttcagaatagtgcagcagaatgcattattttgaattctgcaatgtttaatttgtgattattccaataaaggttgctttgcatgaatatactacagtgtaaaaccatgtgcaaataaatgcataagatatttaaaaacagaagtgttaataaaaaacgcatgtaaagatgaatacagattaaagaaactattttcacatgtcaggaagctggtatacaaataaaagatcaaaatcggatgtgtatgttaactctcattccaatcttcctttcaatatcaattctcgttaatcacttttagtgtcctgacttaaaaacaacattgcatt

SEQ ID NO: 401882 - DNA, 492 bp, Homo sapiens
gggcatggcgttctagaggatcccttctggtggtgatgaaataaacatccgtgaggtcagtggaggtgggcttgaggagtgtagcagaaggttttgcgtccctagcgtctcttctacttggatgacccccagtctaattctcgggactatggggatttacataaacataagaagagttaattttcccgcctcctggcacgcaagcgtgcaatccactagaacaggggtcccaaacccccgggccacagaccgatacctgtccgtggcctgttaggaactgggccacacagcaggaggtgagtgaagcttcatctgtatttacagccactcctcattgcttacattactgccagagctccaactcctgtcagatcagaagaagcactagattctcacaagagtttgaaccctaatgtgaactgtgcatgcgagggatctaggttgcatgttccttacgagaatctaaggcctggtgatctgtcactgcttccc

SEQ ID NO: 401883 - DNA, 461 bp, Homo sapiens
gggcatggcgttctagaggatcccttctggtggtgatgaaataaacatccgtgaggtcagtggaggtgggcttgaggagtgtagcagaaggttttgcgtccctagcgtctcttctacttggatgacccccagtctaattctcgggactatggggatttacataaacataagaagagttaattttcccgcctcctggcacgcaagcgtgcaatccactagaacaggggtcccaaacccccgggccacagaccgatacctgtccgtggcctgttaggaactgggccacacagcaggaggtgagtgaagcttcatctgtatttacagccactcctcattgcttacattactgccccaccatgatcaatatttgctttgaatccccgcagcaacttacatgaaatctgggctcttcacatcctggcacaggctctctctctctctcatgtgcctgataagtccta

SEQ ID NO: 401884 - DNA, 610 bp, Homo sapiens
atgagtgttctgaaaaatcctccttctaccaaaaagcctacatacagtgaactgcaaacggaactagtaagctagcctgtaaccacagctaccctaaagatatctgccaagatgaggaactacagtcaacttatagatatctgccaatatcagaaagaagagccttaaatttttttattctggagttggggtctcactatgttgcctagcctggacttaaactcctgggttcaagcgatcttcctgcctcagcctcccaaatagctggtactacagacacacgccaccacacctggctgttggattttgatggcaccccgagggacagaagacaacgccttaggcccatataaggtggggagacagattctagacattgcagagtaacccgaacagactaacctatcctcagttagcaactataaaacctagacaaaacaaaaaaaataggtatttgaaggtgtggaagagtgaccaaaagtaagtatgaactggatgaagtctatatgtgaaaagagatttgctggagggcaacttcccaaacagcatggctcatgaaggcagaaagccacaggcttactggcttgaggaattagtgcaaagtgggcag

SEQ ID NO: 401885 - DNA, 231 bp, Homo sapiens
cgtcagccgctcaccagctctctctcttcccctcctcagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggaacgtatgtgtttccatgacaacctccctcactatgggatcctgcgggg

SEQ ID NO: 401886 - DNA, 4863 bp, Homo sapiens
gtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtgtgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggaatgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtcgtatcctccactggggaagtgctcccagttcagaacaagggcagcccgtggtgctgacctaggatataacaaagctcttcacttcaaaacccctgcaatagctgggtttacagacatttaccacctggggacccaaaagagaaggcctaggagagttttctagaaggttgggattgtcagggtcctggccccccagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgctcgaggggtgcagaccgcagaattttcacagcaggggctcttggaactctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcc

SEQ ID NO: 401887 - DNA, 4521 bp, Homo sapiens
gtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtgtgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggaatgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtcgtatcctccactggggaagtgctcccagttcagaacaagggcagcccgtggtgctgacctaggatataacaaagctcttcacttcaaaacccctgcaatagctgggtttacagacatttaccacctggggacccaaaagagaaggcctaggagagttttctagaaggttgggattgtcagggtcctggccccccagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgctcgaggggtgcagaccgcagaattttcacagcaggggctcttggaactctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcc

SEQ ID NO: 401888 - DNA, 1181 bp, Homo sapiens
gtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagtaaggccacctcattgaagcaaggaggaggacatgggtggggcagagaggatggcccacttccttatctcctcccctgggatacaggagccactgtcttcgggggagtgggaggagggtgcagatctggagataaatttatgcctttggccatagacaggactggaatcccagttctgccacttactggctgtttgaccttaggcaagccactcctcctttctgagcctcagtttctttacctgtaagataaaaagaatgaatcattactaccctgtg

SEQ ID NO: 401889 - DNA, 1078 bp, Homo sapiens
gtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtttatacgacgcatccatggaacaagcgtcaagtccatccagggaagattctagaggataccccccatctcgtcgcaccaaacca

SEQ ID NO: 401890 - DNA, 451 bp, Homo sapiens
cctgtttgggagcggcctgcctgtgtttttcttggagatcatcataggccagtacacctctgaagggggcatcacctgctgggaaaagatctgccccttgttctctggtgagtatgggacggaggtcacttggggcctggcactcatcagttccacacatttttattgagcacctattgtctgccaggtccattggagcctcatgcacatcacttagctctatgctgacacaagatagcagccagtacagtaccagtgtgatgcggatgctgctgcttaggagtacggggaaaggagatgtggcaagtgcctagcacgcagtagctgctcagtaaggcccagcatgcccacttccctaggttgttgcatagagaagcctgcagctgcactgttcacagtagcaaagacatggaatcagcctaggtgcccatcggtggtggactggataaag

SEQ ID NO: 401891 - DNA, 4937 bp, Homo sapiens
gcccaaagaactcaaacaaatttacaagaaacaaacaaccccatcaacaagtggccgaagatatgaacagacacgtctcagaagaaggcatttatggagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtgtgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggaatgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtcgtatcctccactggggaagtgctcccagttcagaacaagggcagcccgtggtgctgacctaggatataacaaagctcttcacttcaaaacccctgcaatagctgggtttacagacatttaccacctggggacccaaaagagaaggcctaggagagttttctagaaggttgggattgtcagggtcctggccccccagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgctcgaggggtgcagaccgcagaattttcacagcaggggctcttggaactctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcc

SEQ ID NO: 401892 - DNA, 4650 bp, Homo sapiens
gcccaaagaactcaaacaaatttacaagaaacaaacaaccccatcaacaagtggccgaagatatgaacagacacgtctcagaagaaggcatttatggagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtgtgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggaatgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtcgtatcctccactggggaagtgctcccagttcagaacaagggcagcccgtggtgctgacctaggatataacaaagctcttcacttcaaaacccctgcaatagctgggtttacagacatttaccacctggggacccaaaagagaaggcctaggagagttttctagaaggttgggattgtcagggtcctggccccccagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgctcgaggggtgcagaccgcagaattttcacagcaggggctcttggaactctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcc

SEQ ID NO: 401893 - DNA, 3248 bp, Homo sapiens
cggcatgtaccacttggtctactcgtggaataaagcctttatcaaacatgtcagcttcatcgaagcctgactgacggagcgcttgtgatgatggcgttgtggcaagcccatttgagttttgtattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtgtgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggaatgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtcgtatcctccactggggaagtgctcccagttcagaacaagggcagcccgtggtgctgacctaggatataacaaagctcttcacttcaaaacccctgcaatagctgggtttacagacatttaccacctggggacccaaaagagaaggcctaggagagttttctagaaggttgggattgtcagggtcctggccccccagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgctcgaggggtgcagaccgcagaattttcacagcaggggctcttggaactctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcc

SEQ ID NO: 401894 - DNA, 1263 bp, Homo sapiens
gtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagtaaggccacctcattgaagcaaggaggaggacatgggtggggcagagaggatggcccacttccttatctcctcccctgggatacaggagccactgtcttcgggggagtgggaggagggtgcagatctggagataaatttatgcctttggccatagacaggactggaatcccagttctgccacttactggctgtttgaccttaggcaagccactcctcctttctgagcctcagtttctttacctgtaagataaaaagaatgaatcattactaccctgtgaggcaggtatgcatacttatgttgtctaaaaatgatacagttttcttaatgtattttaggaaaaaatatattctgttattgc

SEQ ID NO: 401895 - DNA, 382 bp, Homo sapiens
ttggtctcccccattccacatccatcttgctttcttgactcttgctttgtgagccttaagctccagcataaaacatgaagaacagccttgcagatatgaagaaatacagataaacagtgactctgcttttctgattgaacccagctgatacacaagcctacctgcatatacaaataagaacatatttatgtatgcatattatatgtatatatattcatatatattatatatattcatgtttatataatatatacattttatttttgtataaacatttatatatttatgcttatatgtacaaacagaaacatatgtaaatgtatttgaaatgttaaaagaaatcaaataaattgttaacaattattaaacctagatagtgagt

SEQ ID NO: 401896 - DNA, 204 bp, Homo sapiens
tcccacagcccctctgctcccagccccagccacctccatactaccttccgtctctaagaatgcgaccactccagccacatgagtggagccatagagcatttctctgtgacgggctcactctacttggcatcacgtcctcaaggctcatccatgttacagcatgtggcagactctccttccttttgaaggctgagtaatactcca

SEQ ID NO: 401897 - DNA, 449 bp, Homo sapiens
ttccacttcagcccctcaagtagctgagacaacaggcatgtgccaccatgcctggctaatttttgtattttatgtagagatggggtctccctatgttcttcaggcttgtcttgaactcctgggctcaaacagtccacccaactctccctcccaaagtgctgagactacaaacgtgagtcaccgcacagagctaagacctcattctttacacgtggagctccagcgaagtttgtgaaggagagagaagattaatactgtaactcagaaagtttgatgagccaggattgatggacagattctcttaagagagggttgtttacagacccagagttttattaatacttagattagagagaaagtaatggtgtgaatcggggaatgaaactgtgtgactcgcatgtagatataggttcatttcacattaaaaaaataaaaataattgattttta

SEQ ID NO: 401898 - DNA, 590 bp, Homo sapiens
atgggtccatgggaaaaaataaaataaataagctgccaattccacaggaaatataatatggaaaaatacatacttattatgggttgggttacatttataaataaactagaactaacgtgtataataatttggtatcaaatctacgtttcagggaatactaagaaatacactgagtttttaaataattcataatcaagttccgacttattaaatggcttccaaattatataatactattttgctgaaagagtaacaaactatgattaagactaattttaagcatatctacttcattttcacgtctaaaaatgtctgaaatagttaataaataactggttaaacagcaggcctctaaactagcaaacatttgtcaaagcaaaaacattctgtctgacgggaaaatgtaatttatgaaaatgatcaaaacatagagtccttcaaagaattttacaatcagttgagacaagttaacaaagctgtaaggttccagtgagtatttaaatctaacctgtgataaggaaagagacttttatccacataacctcccaccacgcaaaacaaaagcattctgaatcaggaagtagttagcg

SEQ ID NO: 401899 - DNA, 221 bp, Homo sapiens
agagaggcagatcccttacaaaatggagatttcctttatagatgtaaatttcttacagagtttcaaagtagccagctgagtgccagaaatgtaggcccttgtacgttttatttagcagtataaagtgagtcaaggatgccaccaggttcctggcttatgttaatgggtagttaacatccactgagataagaaatacaggacacttgttgctgtttatttgg

SEQ ID NO: 401900 - DNA, 177 bp, Homo sapiens
tcacgcggcaggaaattgatagaaaatctcgaaccaatggtttattttcttctccatcactttaaagcacacaatagaggacggagacaaagaatcaaaaacaaaggatgatcagttcctccaaatagaaatgcacaaaggtatttaataagggcaaattatttttaaaataaacgt

SEQ ID NO: 401901 - DNA, 212 bp, Homo sapiens
tgagggaaaggatctatggactggagaccttgaggcaggggattctacagtttaatcatctgtagccacagtgaactgggttaccaacctttcagcaggagctgaaggtagagcacgttcgaagactgccaagtccaggacataccttttgcagacaattacgacaaacttggctccttggctttctgccatccagtattttgggagtaaca

SEQ ID NO: 401902 - DNA, 470 bp, Homo sapiens
tcgactactacttctctctctctctccccctctctctcccctctctctctttctctcttcctctctctttttttaagacagggtctctatctgttgcccaggccagagtgcaatggtgtcatcgtggcccactgaagcctccaacggctggcctcaagccattctcccaccttggcttcccaaagtgttgggattataggtgtgagacaccacacctagcctagtcctttctcttaaaggaagctgtgctgctcaaaaactatagcagaaatgtgttccttgtgtggtccgcttccctgtgccttccttctgtgaaggtgttccccgaactcacaaggagtccgcaaattctgcaggtccttcctagttcccaccccacttctccaatgatcctctggttcctgttgtgaggatgtaaaaatgcacttgctgctgaaatgaagctgaatcagagatgatgtttttctccc

SEQ ID NO: 401903 - DNA, 220 bp, Homo sapiens
aaacacaacataccaaaacttatgggacacagaaaaatcgatgctaaggggagaaatttatggctataagcatttacactaaaaaagagaaagatctcaggccgggcatggtggcttatgcctgtaatcccagcactttgggaggccaaagtgggcggatcacctgagatcgggagttcgagactagcctgaccaacatggagaaaccccgtctctacta

SEQ ID NO: 401904 - DNA, 579 bp, Homo sapiens
cggagatggaacttttctctgcatttctccagttgcttttttccccctgctactttctcggcttcattcgctgtctctgcaaatcctccatccactctctactttgccatctgcttacggctctccctcaatcttcttttctccttcaaaatttttctctttcttctccctcgctctccgtctctctttctgcacacattcacatggaaggaattgggatccgatgtccacaagcagaacaccttttcagtggggtgttatttggcccgcaagaacactggatgtcaagagacagagtaagtcacctccccacacgcagggttaggagaagcggtgtctgggaagaggaggcctggggagtagcggggccccgtatcaaggagggtaaaggtagggtctggatcaagagatgggtggcgtctgcagaatcccagcactgggcagaagacgcggcttctcctggattgagattggagcgctgtgctccagggccaacaaaggcgaggcttgggggaccgcatagaccggaatccgcctagcgggggaggactttacgctgtgcggggcggatgtaagcat

SEQ ID NO: 401905 - DNA, 425 bp, Homo sapiens
gtgtgagagcagaggaaaaacatggtttgcgagttttgtgctaaaaaaccctgagataccaaaatgtgtgatgctcaagtcccttactattggccttcatatccatggtttctatatctgcaggtatagaaagcccagaaagaccaggccatggttagaagcacagaattgtcagcaccaaccaccatcctccaggaagggtacaggggctggagactgagttaataccaatcatgcctaagtaatgaagcctccataaaagttcctgagagcttccacatgctgaacacgtgcggtgggcctcaagggcggcacacccagtgaatcttcccatgtgcctcgccttgtgaatctcctcatctggctgtccatctgtatccttggaaacatccttcctcatgaaccaataaacataacgaagtgtt

SEQ ID NO: 401906 - DNA, 598 bp, Homo sapiens
cggagatggaacttttctctgcatttctccagttgcttttttccccctgctactttctcggcttcattcgctgtctctgcaaatcctccatccactctctactttgccatctgcttacggctctccctcaatcttcttttctccttcaaaatttttctctttcttctccctcgctctccgtctctctttctgcacacattcacatggaaggaattgggatccgatgtccacaagcagaacaccttttcagtggggtgttatttggcccgcaagaacactggatgtcaagagacagagtatagaaagcccagaaagaccaggccatggttagaagcacagaattgtcagcaccaaccaccatcctccaggaagggtacaggggctggagactgagttaataccaatcatgcctaagtaatgaagcctccataaaagttcctgagagcttccacatgctgaacacgtgcggtgggcctcaagggcggcacacccagtgaatcttcccatgtgcctcgccttgtgaatctcctcatctggctgtccatctgtatccttggaaacatccttcctcatgaaccaataaacataacgaagtgtt

SEQ ID NO: 401907 - DNA, 2540 bp, Homo sapiens
gggcttggtttcctgggcgaccaccgctggctagtccgttagaggcgtgcgggcttcggaggcgtgcgggcttcggaggcgtgcgggcttcgggtgccatggggactcctcccggcctgcagaccgactgcgaggcgctgctcagccgcttccaggagacggacagtgtacgcttcgaggacttcacggagctctggagaaacatgaagttcgggactatcttctgtggcagaatgagaaatttagaaaagaacatgtttacaaaagaagctttagctttggcttggcgatattttttacctccatacaccttccagatcagagttggtgctttgtatctgctatatggattatataatacccaactgtgtcaaccaaaacaaaagatcagagttgccctgaaggattgggatgaagttttaaaatttcagcaagatttagtaaatgcacagcattttgatgcagcttatatttttaggaagctacgactagacagagcatttcactttacagcaatgcccaaattgctgtcatataggatgaagaaaaaaattcaccgagctgaagttacagaagaatttaaggacccaagtgatcgtgtgatgaaacttatcacttctgatgtattagaggaaatgctgaatgttcatgatcattatcagaacatgaaacatgtaatttcagttgataagtccaagccagataaagccctcagcttgataaaggatgatttttttgacaatattaagaacatagttttggagcatcagcagtggcacaaagacagaaagaatccatccttaaagtcaaaaactaatgatggagaagaaaaaatggaaggaaattcacaagaaacggagagatgtgaaagggcagaatcattagcgaaaataaaatcaaaggccttttcagttgtcatacaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgtgattgataacttaggaagttcacaatgtattttctacttctgcaattaaatattctttagtgcttgtttattattactaaatactaattaagtactaacaagtacttaaatactaatgtattaagtatttaagtactttctaataaaatctttaacaataataatgtaaatttcagaatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgttttttttttttccctaatagagatggagtatcgctatgttgctcaggctggtcttgaactcctgggctcaagctatcctcctgcctcagcctcccaaagtactgggattataggtgtgagctactgtacccagccttaacctgtttcacagttgattatacttcatgctgtttcccagcatggtattattaagggatttaaagttggggttgcatgcctgtaatcccagcattttgggaggccgaggtgggcggatcacgaggtcaggagatcgagaccatcgtgactaacacagtgaaaccccgtctctaataaaaatacgaaaaattagccaggcgtggtggcgggcgcctgtaatcccagctactcgggaagctgaggcaggagaatggtgtgaacccagtgagccgagatcgtgccactgcactccagcctgggcaacagagtgagacttcgtctc

SEQ ID NO: 401908 - DNA, 2047 bp, Homo sapiens
gactgaagagagagaagacagacgggagaggaactttagcacctgagggaggacctgggtttcctttttgcttcacacatcccaaactagataatggggaaggtggcaagctggaagtgccgatcagtgcagaccaaaaagaccctgagaagagctgctctcttttaacaaagaatctaagaaggaaaggggcaacctagcaagacagaacattttttagacaataacctctctactccagggaaccaccacataaaagccttcagcctcacatcagcagtggcacaaagacagaaagaatccatccttaaagtcaaaaactaatgatggagaagaaaaaatggaaggaaattcacaagaaacggagagatgtgaaagggcagaatcattagcgaaaataaaatcaaaggccttttcagttgtcatacaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgtgattgataacttaggaagttcacaatgtattttctacttctgcaattaaatattctttagtgcttgtttattattactaaatactaattaagtactaacaagtacttaaatactaatgtattaagtatttaagtactttctaataaaatctttaacaataataatgtaaatttcagaatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgttttttttttttccctaatagagatggagtatcgctatgttgctcaggctggtcttgaactcctgggctcaagctatcctcctgcctcagcctcccaaagtactgggattataggtgtgagctactgtacccagccttaacctgtttcacagttgattatacttcatgctgtttcccagcatggtattattaagggatttaaagttggggttgcatgcctgtaatcccagcattttgggaggccgaggtgggcggatcacgaggtcaggagatcgagaccatcgtgactaacacagtgaaaccccgtctctaataaaaatacgaaaaattagccaggcgtggtggcgggcgcctgtaatcccagctactcgggaagctgaggcaggagaatggtgtgaacccagtgagccgagatcgtgccactgcactccagcctgggcaacagagtgagacttcgtctc

SEQ ID NO: 401909 - DNA, 2464 bp, Homo sapiens
agtgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggcagaatgagaaatttagaaaagaacatgtttacaaaagaagctttagctttggcttggcgatattttttacctccatacaccttccagatcagagttggtgctttgtatctgctatatggattatataatacccaactgtgtcaaccaaaacaaaagatcagagttgccctgaaggattgggatgaagttttaaaatttcagcaagatttagtaaatgcacagcattttgatgcagcttatatttttaggaagctacgactagacagagcatttcactttacagcaatgcccaaattgctgtcatataggatgaagaaaaaaattcaccgagctgaagttacagaagaatttaaggacccaagtgatcgtgtgatgaaacttatcacttctgatgtattagaggaaatgctgaatgttcatgatcattatcagaacatgaaacatgtaatttcagttgataagtccaagccagataaagccctcagcttgataaaggatgatttttttgacaatattaagaacatagttttggagcatcagcagtggcacaaagacagaaagaatccatccttaaagtcaaaaactaatgatggagaagaaaaaatggaaggaaattcacaagaaacggagagatgtgaaagggcagaatcattagcgaaaataaaatcaaaggccttttcagttgtcatacaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgtgattgataacttaggaagttcacaatgtattttctacttctgcaattaaatattctttagtgcttgtttattattactaaatactaattaagtactaacaagtacttaaatactaatgtattaagtatttaagtactttctaataaaatctttaacaataataatgtaaatttcagaatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgttttttttttttccctaatagagatggagtatcgctatgttgctcaggctggtcttgaactcctgggctcaagctatcctcctgcctcagcctcccaaagtactgggattataggtgtgagctactgtacccagccttaacctgtttcacagttgattatacttcatgctgtttcccagcatggtattattaagggatttaaagttggggttgcatgcctgtaatcccagcattttgggaggccgaggtgggcggatcacgaggtcaggagatcgagaccatcgtgactaacacagtgaaaccccgtctctaataaaaatacgaaaaattagccaggcgtggtggcgggcgcctgtaatcccagctactcgggaagctgaggcaggagaatggtgtgaacccagtgagccgagatcgtgccactgcactccagcctgggcaacagagtgagacttcgtctc

SEQ ID NO: 401910 - DNA, 1476 bp, Homo sapiens
agcgattcctcctaaaatggctacaaggccggcggcgcggagtccgcccagtgcgcgttccctgcggcctgcagcctcggcgcccgggacccgccggcctctctagccgccgccgccgccgcctcgatggtgggcagtcgcacgcagcctccagcgccaggagggggcgccaggcagggcctgtcccgcctggggagactgcgcccgggataataggagcgcttggcctctgagactacccggcagaagggacgtccccaaatgacactcggaggccgcctccctgggctccggtgctcggtgccgggaggagcggcacggctttctaccccgcctcaggtgcgccagcacgttttctgggcagcatctgtgtgttaggcgaccggagaggtgggttccttatagggaataagaaaactgaaactgacttccaactgcaggcagaaggaagcagtggtcattgctggaggttaaaactgttctgaccgggcgcagtggctcacgcctgtattcccagcactttgggaggctgaggcgagcagatcacgaagtcaggagatcaagaccatcctggccaacaaggtgaaaccccggctctactaaaaatacaaaaattagctgggcgtggtggcgcgcgccggaagtcccagctacttgggaggatgaggcagaagaatcgcttgaacccgggaggcggaggttgcggtgagccgagatcgcgccattgcactccagcctggcgactcagcgatactccgtccccctctccccgccccaagaaaaatctgttcagtggggagcgacaaggaaggagctttcagcccgactggggtcgcagggaagaattcaagatggcgtgtttaggagctctagctccttgacaaattagtaaaatgttagtcttaggagaagaacgaaaaggctctcctaggctaagaaacagcatacacagtgagaaacctcagaagaaataaaattcaaggaagatagcaacaacgaaaacatcagaaggaacactaaagtagtcaaatcagcctagcagaaacaaagtacgttaaccaatggaaaactgacggagagaaataaactgtttttgcacagctaaatggaaatgacttttgaattatctgctttggaagattatccatgacactgttctgccctgctctgctctaacaacatttgctggtgcctctgccgagatcacccttttattccttatttggtagactcctactcatccttcaagactcagctttaagaaaactttatcttctttaagaaaacttccctggaacctgatatttcatgtcctgatgggttcaacatctttcctccgagctgcaacgtatagatctctagcatttgtccccatgtaactctctatttttattaattatatttataataaaatttttcttcatttttatccccttaactagactataaagttactgatttttcttttttgtcttt

SEQ ID NO: 401911 - DNA, 1314 bp, Homo sapiens
aaaaagggcaaagacagccctagggttgggagggatccaggttttttatgaaaattagtggaatccctaagatacttacctttgtattataagtatttgcatgtctccttctagaaacgtttatcactctgtgttacacagaccagcagtgttggcgtcaactgggagcctgttagaaatgcagaatcaggccccatccccagggttctgaatctgcattttaacaagatcacattaaagtgtgtgagaagcaatgctttgacagctggcagagagcagatccagatttgataccttttcatattctgcatgtaccttatacagagtaggcttttgcatttgcggaatgaaggatacaggaatactgtttactgtaatccatttctaaccagatatgccacttaggcttaaacacggccaatgatggggaaccccaagttacataggccaccctttctgagtgagcagctctatttgctgaaacgttcatttttatattatgaagttgacatcccacttaagtacaacaaattcactactcccctattctttgctctgcctcttataaactcattctttggctcataaaccaaagacagtttacaggaagaaaaaaaaaaggtacgattttactgcaacttcttgctcacccctccaaaatctttatgtctgagtacatgctttttggttatccctacttttctccctccacccctcaattccttaccataggacactgaagcaaggcccttgaagatacataatacattaaaccttgacttgtgtagtattcagttttctgaccccaaggtggtttcaccatgccaaataatatgtccttggtatgtatttccttgcagtagtcaaatcagcctagcagaaacaaagtacgttaaccaatggaaaactgacggagagaaataaactgtttttgcacagctaaatggaaatgacttttgaattatctgctttggaagattatccatgacactgttctgccctgctctgctctaacaacatttgctggtgcctctgccgagatcacccttttattccttatttggtagactcctactcatccttcaagactcagctttaagaaaactttatcttctttaagaaaacttccctggaacctgatatttcatgtcctgatgggttcaacatctttcctccgagctgcaacgtatagatctctagcatttgtccccatgtaactctctatttttattaattatatttataataaaatttttcttcatttttatccccttaactagactataaagttactgatttttcttttttgtcttt

SEQ ID NO: 401912 - DNA, 251 bp, Homo sapiens
tctactatatttgcttgttacagatacttatctagatactatagatattatttttatagctagaagattttgggtgttttgaagcattcttaagttttatcagtaggttctaagaacctatcagtagtttctaagtagtgataaggaaatggcaatttggtttggtttattgaaagtagtgataacagaagctttattttaaaatagttttctaaatataatgcttgatgagtagcaattttatattacag

SEQ ID NO: 401913 - DNA, 338 bp, Homo sapiens
cctgggctcaagccgtccttctgcctcagccttccagagtgctaggattataggcatgagccactgcacctggtgcaaaattctcataatgcaaatatttaaggcttttgatatatactgataagtcatccctctggagaggctgtctgaagtggtgctcccacctaccatgtctggaagtttctattttattaccatccaaggtggtgaatgtcttatgattattgaccattggtatctgtaaatttcttgtttgatatttttttcggcgtgttcaccttctagtttttttgttttcgaaagaacccttgcgctggaaaggatggtaactgactctt

SEQ ID NO: 401914 - DNA, 444 bp, Homo sapiens
ctgggtgaaatatgtcccacctcagagtgaatgaatgccctaaagataggatgaaacctggggacctgatcattagggttttaccttgaatgagaatcaggtcataaggcccccagggatttattgaatgagaatcaggtcatagtatgagagctccccaggaatttatttcccaaaactcttaaagagggagttgaaagcctcaggtgaggacccagatatttgtatgtaggtgtacaaagcaaaacaaaatgaatttgagattataacatagagtgatcaatatgatgtcttaggtgtcaccacagttggtgggctaggactcatgcttataatgcatcggtggaagggtatgtcccattcagaagtagcagacctgccatgaagggcggtgtagcagcaccatgtgtcaaagagagattcccctgtgtggaaggacagcca

SEQ ID NO: 401915 - DNA, 296 bp, Homo sapiens
  misc_feature (245)..(245): n is a, c, g, or t
ctcatatgtggaagggacttgccttgcctcagatgagattttggacttggacttttgagtaaagactggaatgaattaagactttggggacttgtcaggaaggctggattggttttgaaatgttttgtctccagatttttctgaaaatattaatgaagccagctgggaagaggagcagtttggatgagactgggataagaagtggttaataaaatctggttatctattctggaaaaaataaaccntgatgcggccgaaacccggtcacacgattgccgctgcgcgaatctgcttat

SEQ ID NO: 401916 - DNA, 432 bp, Homo sapiens
ctcatatgtggaagggacttgccttgcctcagatgagattttggacttggacttttgagtaaagactggaatgaattaagactttggggacttgtcaggaaggctggattggttttgaaatgttttgtctccagatttttctgaaaatattaatgaagccagctgggaagaggagcagtttggatgagactgggataagaagtggttaataaaatctggttatctattctggaaaaaataaacagctgataccaccattctgaactattacagtgaattccacataggcactgaaggtgcaagctttcatgaattgcttgcctttgagtcaggtactgtgttaaggacattatgtttaggactagatttacttctccaaaaagctaattccatgagttctggaggttgggaagtccaagataaagatgccag

SEQ ID NO: 401917 - DNA, 640 bp, Homo sapiens
ctcatatgtggaagggacttgccttgcctcagatgagattttggacttggacttttgagtaaagactggaatgaattaagactttggggacttgtcaggaaggctggattggttttgaaatgttttgtctccagatttttctgaaaatattaatgaagccagctgggaagaggagcagtttggatgagactgggataagaagtggttaataaaatctggttatctattctggaaaaaataaacagctgataccaccattctgaactattacagtgaattccacataggcactgaaggtgcaagctttcatgaattgcttgcctttgagtcagaatctggaacgctgaggaggtctctttccagtaacttggaccagagacaactgtaaatgtgctggaagccagaagatgttggggaagctggcaaagagaaaacctgagagttatttactgctcagcctgcagcatccatgagtgactgaagggagtatctggacctttttctcacttccaaaagcaagtgctaccagaaaggaagaagaaaaccttgaagttatcttagcctacaacagtgatatcatccatatctttattgtcatggatgaaaatgggaaataaaagattctgatggctcctaactc

SEQ ID NO: 401918 - DNA, 155 bp, Homo sapiens
gcttccctccacagggagatggagaaaagtaggctgtagggatccattggttccatggaaacagaattctggagacaccaagaaatggaggccccttaaagggtttcactcacccattattcctttcctttttttttttttttttttttgagaca

SEQ ID NO: 401919 - DNA, 829 bp, Homo sapiens
ctggtctcgaactcctgacctcaagcaatctgcctgcctcagcctcccaaagtcgtgggattacaggtgtgagccaccccaccaagcctggctaatttttatatttttagtagagacggggtttcaccatgttggccaggctggtctcgaattcctgacttcaagtgatgggcctgcctcaatgtccaaaattgctgggattccaggagtgagccaccacgtccggtcctgccatcattcttaacaagagcgcccccaccatcgtccagggagagatggaatatccagagaagaacagagctcacagaaggtttaaaaaacaaaatggccaaggctctccccaggtgtcgatggggtgggaggcatggcccaactcctgaagatgtcatggcacagtgggcagccaccatggggaatccggccgggatgacagagacagccctgcagcacggcactgctcatagtggggccaggccctggaggagtctcctgaagccacaaacatacatagtccgcaccctcccctgccccaaactcagcgtgtagcagatcaacctctgtactatcagccaagccaatacaacaagcacagtgattgtggactactccccaagaacaaaacatcgaagaacagccaagctagcacgctggctcacgcctgtaatcctagcacttttcaaggccgaggcaggcggatcccttgagcccaggagttcgagaccagccttggcaacatgatgaaaccctgtttctacaaaaggcacaaaaattagctaggcgttgtgggaggatcacttgagccaaggaggtagagtttgcagtgagcctt

SEQ ID NO: 401920 - DNA, 527 bp, Homo sapiens
tgtagacctcagaaaagcacgatgattatttacagatttccagaatctctactggattctttgcttttcctttctcacaaggaaactttccaggatacagagcacaacaggatctgaatggcagtgaattctctttaacatatctcttcagggtgatgggggcttcactggtatagaggggtcagggtcagcccctgttgtttctgcttatgggttggagaccccctatatgtgcaagaaatacactaagccaacttactccattaatgatgatagcatggctttgtatattaggatgtgtgtgcatatgtgaatgataggatatacgttaatagtttgtaataataaaagattgaaagcaacataaatctgcattaaagacacttattaaaaaaaccgtggtatatccacacaatggaatactatgcagctataaacaagatgcaccaatatggaatgaactccaacacttacttgtaaaaagcaaggtacaaagtagagcatatacatgaatattgattgtcttt

SEQ ID NO: 401921 - DNA, 606 bp, Homo sapiens
gccaggtgcaatggctcacacctgtaatcccagcactttgggaggccgaggtgggcggatcatttgacatcaggagttcaagaccagcctggccaacatggcaaaacactgtctccactgaaaagtccaaccttaaaggtacactgatttatctttacaaataccaattctggtggagcataatagcatggttaaaacaacgttctccctaaatggcgacgatctacggggcggaaatatgcttggaactgacggtactgcctgcaggcgtgtgctcgtcagaatctattcccaacacagtagaagcggaggtttcaggaggtgcagagtgactagaccacagcatgtgtgtaagaaaactgacactgaatgaaaacaacacaaaacaaacttcatctcagtcagtgctttctgtttgttgcctgtcaccactcagcgtttagagaaaacgtccttgcctctgtaaatcaaagtggctcacgagggcattgaaacttttcgtatgtgagtgctctataaattttggttgcattttattcagacttcactagaaacttccagttattcaatgaatgttgtgccagaaaacatcagttttgtaaggga

SEQ ID NO: 401922 - DNA, 286 bp, Homo sapiens
tgctgggattacaggtgtgagccaccgcacccaggctactctcatctttttaaacttggaatccaaaatcctctataatctgacccttactgaagtcctgaacactggtgaacaacgttggtctttgccgaggggccagatttctttttcagaccatgttgcagctgaccttgaccctgagtatctgagggaggagctttggggcacaggcagctctgtgtgccattcttgctttcagaagagtctcccatgtttgggtcccagaaaagtgatctgtggtccaggc

SEQ ID NO: 401923 - DNA, 514 bp, Homo sapiens
gcgtggtcccagattcctcactcttgaccttataatgctaagaaaggggcatggagtggataggaacagagcctgagatgcctggggacaacagggaaagatagaaaatatttatagggtagaatgtggtcactgtgccagggcacttttacaaacatgatgacatcaaagtttcacagtaaactctgaaggtagatattaccttcgttttagaaaacaggctcaaggcttcgagtaattttgcctgtgatcaaacagctggcagtagggcccagggcccaacttgtctccaggtcttctgatttcaagactgttgtttttgttttgttttgttttgctttgctttgttttgagacagagtctcactctgttgcccaggttggaatgcaatggggtaatcatgactcactgcagcctcaatctcctaggtctaagcaatcctcccacctcagcctcccaagtagctgagactacaggtgtgtgccaccacaccaggctaatttttatattttta

SEQ ID NO: 401924 - DNA, 334 bp, Homo sapiens
ccctttttattgagtagtattccattgtatgaatataccacagttggtttaaccatgtaatagctaaaggacatgttccatttggggccattataaataaaatcactgtaaacatttgcatatgggtgtttatgtgaacataagtttttatctcccttaggtgagtacctgggagtgggactgctggcttatggcaagaatttaacttcagtagaaactactggccgggcgcggtggctcactcctataatcccagcactttgggaggccgaggcaggcggattacctgaggtcagaagttcaagaccagcctggccaacatggtgaaaccctg

SEQ ID NO: 401925 - DNA, 439 bp, Homo sapiens
ggaattgaagcattgccccaggttctagagggtcaactcctgtgaggaaacttgttactgcataaattgggactaaagccagacctccaagttcctgtcccactgtcttttcacttatctgtctcatccatttttcaagtccacctttgtctttaggagagataattatgtccctcacacaatacgctatactgagaatgggctgtggggatgaacaatgtgaaaactgaaaagaggaagaacacatcttaggaaaaaaatcgtcatattttctctaagaaaataaataacttcataaagtttattgtacaggaagacttggatcattcttgaattttcattgcaaatcaaaaacaggaatttgactttattatcttgggagaaataggaatagaaaagtgtataaaaaataaactttttttaaccaagaataaattgc

SEQ ID NO: 401926 - DNA, 949 bp, Homo sapiens
gacagcgtttcaccatgttggccaggctggtctcgatctcctgacctcaagtaatcagcacacctcggccttccagagtgctaggattaccggatgacccacacgcccggcccatttttgtatttttagtagatacagggtttcaccatgttggccaggctgctctcaaactcctcaggtcaagtgatcctcccacctatgcctcctaagtagctgggaccacagacacacagacgtgcaccaccatacctggcgaagttttgtatttttggtagagatggggtttcaccatgttgctcaggctgttctcaaactcctgagttcaagcgatctacctgccacagcctcctagagtgctgggatgacaggcatgagccaccgcacccagcctctgcgtggggtttcgtcagggctgggtctgtgccctgaaggggagctcattccagcccagctccccactgctgcagcttgtgtgtggactcctccagaaggggagcgggagtttccctgtaggagtttatcatccatggtgaggagggcagcagggggcactatttcctcagggtgaggtctttagttaggcctctgagcccaagctaagccatcatatcccctgtgacctgcacgtatacatccagatagcctgaagcaactgtaaaaatatccttaactgatgacattccaatattgtgatttgtttctgccctaccctgactgatcaatgtgctttgtaatctcccccacccttcagaaggctctttgtaatcctccccacccttgagaatggacttggtgagatcaacccgctgcctgcaaagcattgcccctaactccaccgcctgtcccaaaactatgagaactaatgataatcccaccaaatttgctgactctcttccagactcagcccggtgcaccaggtgaaataaacagcctcgttgctcacacaaag

SEQ ID NO: 401927 - DNA, 183 bp, Homo sapiens
tcgtaacagcagctgatgatatactccctaatgaaaaatcactcatatatagaagatagtgcatgtcctcaccagccaagaagatttttgtttaccttctctagtttgtattttgaaaataataaatatttttaattctctgaacacaaaattatgctattaaacatggtttttaaaaatata

SEQ ID NO: 401928 - DNA, 101 bp, Homo sapiens
atttcctcatgtctgttataatggcattctagcccaacataatcatgtccatctcttggaatgcattgtgtagactttaacttatatggttctgctctact

SEQ ID NO: 401929 - DNA, 207 bp, Homo sapiens
agtagagatggggtttcaccatgttggtcaggctggtctcgaactcccgacctcaggtgatccgcccgcctcgacctcccaaagtgctgggattacaggcttgagccaccacacccggccccttttactctattaatgtgccatttaagtgtgaagtccacttaagtgtgaagtgaactaatttctttcttaatatttttggcttct

SEQ ID NO: 401930 - DNA, 1944 bp, Homo sapiens
  misc_feature (1011)..(1011): n is a, c, g, or t
aaaaggtaatgtatggaaaggaaccaaccatctgaaataatagtcctaaatccaactagataatcttttaaagctgtaagagtcagagatggagatttctaaactttcaaagaaaacttgattgcaaatgagaaacctgtgcatttttgaatgcttattgaatttgaatgtctgtgtgggccaaaaagaatcagagggacaaatggaaggcaggaaagaaaaggtgtaaattttagatgtgttttaaattaatgtatttaatgacatattagactcattacaattttattgactttccctttacatttgaatgtaattttttactagccgatgcaagctgcaaaatggcgagtcttctaaggtgcctttccttccctgggatcctcatcttagaatgagcagaggcacatcgataagaactggaccttgatttcacaacctcatacaaagccaggcaattcttgagccaaacaaagggggtgtaagctatttcatttattttgataatcctcctcttgcacgggagcattttgctgtctttgtcaaagtgaatgacaacaatttggccaactctctctgagctgcactcaacagtgacaggcaaattatcagaggccctgcacttcttattatcagaggagaagccatcagggggacgcatggaggatacctctcccttgtcactatttgtcagtgggacaagggccactgctatgggtagctgacaggtaatttcaacaataacaattactcctattactggtgtcataaacaattcgcccaaggcatgacaatagcaaagctttataattcaatgccatataaataaatgccagcaggtaacaagtaatttagctccaatcaagctttcaccccggcattaatattgttattgcaagaaaatggaaaattgaaaaaattcaatatgttaatgaattaagagaggttcaagggctagacaagacgagttggaaaaaggaaacaaaaattattgtggtatcatatttggtnccatcctggaggccaaacatcagtataattactttaagacaagaaggggaactggagtgccttagatctcagagcagggaaaaatgtgacatgagctttcaaaaaatccacctaactccaatttctgaagaatataaggagaaatatgagagtgtatatatataatgtagcatttcactggctttctttttctacctgaaatatttcatatgaagcagaagcatgagtatcaaagaaacgtttccatctgtttaagaaaattgtatcagcacctgcttcctttacattaagtctcataatgaaactattttaataatccttttttttttaatctggggtgaaggtaaagctgaaagtcatctttgctctccagctgtccaccttttggaagtggactagaggatacagtgttatcttcatacgtaaaacttcctgatcaagccaatttgcaattttagtatttgtccagcaagacaatgtgccatcatggtgacagcagtaaaagaatttgaaaatctctaattaggagagctgcacaccaattaacgcatgtcaaatttcacttcatcaagtgccactctaattttccctctaaaaattaatggattttttttcttttggtatgtgtgtgtgtccccttaaggcaatgttgattcaaatctgctcgagatgcagtgttgcacagctaagcatcttcttgattacaatccgccacacttctaactgcgctcattcgcactgccacggatactttgtcaacagtcaaattacaccacgctgataacaatgcataatggtgttcctcctccagtcccctgtcaggagaggggcttcataaaaatgtgatgttttcttctcaactgtatctaaaggaagtttgtatgaccaggtccccagtcaggtgttgatttttaaaattagtttgttaatttc

SEQ ID NO: 401931 - DNA, 535 bp, Homo sapiens
tgagttgcccagagcccacagtgtttgctttctcaccactccggactccacctttgagctctttgcgagagatgtggatttccagctttgaacaatccaagaaagaagcccaggcactaagttcaactatatttatatgaagcaatgtgtagaaagtagtcctttagtacctattcagcaggaatggctggatcacatgttaaggctgatacctgagtctttaaaggaagggaaagaaagagaagaacttcttgaaagtctcataaatgaggtgtcaagtgactttgaaaacagcatgaagagatatttggtgcagagcgttcttgtgaaaccaccagttaaatcgcttgaagatgaaggaggtcctttacctgaatctcctgtaggcctagattattctaatccttggcattctagctatgtgcaggcaagaaatcaaatattctctaatttgcacattattcatccaactatgaaaatgttactggaccttggttatacaacatttgctgatacagttttgttggacttcaca

SEQ ID NO: 401932 - DNA, 2219 bp, Homo sapiens
gacagtgtacataagagtttcttgttgctttacaataaaacatgagaacctgcagcttgtgatgttgtggcagtggcagcctccgcggctggtgccaccacctttgcccaggcccccgcagcagcacctgcctcccaggccactcctagactcacgtgcctggccgccccacccaggggcttctgccagccctggcggcgccttggtgctgtgtgggtgtcattggcatgttgaccaacagcctcctgccctgcccagctggagctgtgcccccagctgcgctgcctgaggcctgtgggtgggtgggaggaccagggacggggacagggagatctgggagcctcggcctccaccgcagggtgagcaggtggagcagcagcaggagatgctgggtagggagtgtggctggtcctacctgcgctgccttgctttccctgaagggattctgctcagggaggcagagtctaggcgacctaatttctaggggcgaggacaagaacacagccgcaccgggatgtggctgaccgtctacctccctcctagggggctggcaggggcttctgggacggttttgggacaggtctggggcaccagaaccggctcaggcaggtctcccaccccttaccctgggggtccccatgggaatgaaagccaggagttcatcaggcacccagctgagtcgagggggcgggacccagtgcagcccggcccctccctggcccaggacctcaaataccggcccctgccttggtgccagagctactgccagagggagtcagtgcagtcctgtgtcggacacgcccgcagcctggacccgggatccccatccccctaggatctctgagcctcgggcctctgcacccacatccaaggtgagtctctcggctgccctgagctggggctggatgggccggaccctccattccggctgcagcttcccgcgcagtgagaaggcagcggtccctgagagcccagcagtgccctgggagcctgcagaacgcaggggcggattccgcgtcgcactggccgtcaaggggcggccgcggagggaaggggtgggtcggtgggtctgacagcgggtctgcgtaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcgggccccgggaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctgactggggcatgccacctgcagaccctggctctgaggaatggcccaacagtggccccttcagggtggcagccacccttcagtgaggccccaaggcagagtcggctgggcgtggaccaggggcatggacacgtgatgtgctgctctgtacctccgttccccatctgtgggacgggctggatc

SEQ ID NO: 401933 - DNA, 1245 bp, Homo sapiens
tggcagggcctgggttacctcgggctcccgcgcaattttgggatgtgcagtcctgtgtcggacacgcccgcagcctggacccgggatccccatccccctaggatctctgagcctcgggcctctgcacccacatccaagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcgggccccgggaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctgactggggcatgccacctgcagaccctggctctgaggaatggcccaacagtggccccttcagggtggcagccacccttcagtgaggccccaaggcagagtcggctgggcgtggaccaggggcatggacacgtgatgtgctgctctgtacctccgttccccatctgtgggacgggctggatc

SEQ ID NO: 401934 - DNA, 1268 bp, Homo sapiens
tggcagggcctgggttacctcgggctcccgcgcaattttgggatgtgcagtcctgtgtcggacacgcccgcagcctggacccgggatccccatccccctaggatctctgagcctcgggcctctgcacccacatccaaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaagatcctggctggctatgacctcgcgctggtgcaggaggtgcgagacccagacctcagcgccgtgtccgcgctcatggagcagatcaacagcgtgtccgagcacgagtacagctttgtgagcagccagcccctgggccgggaccagtacaaggagatgtacctgttcgtgtacaggaaagacgcggtgtcggtcgtggacacctacctgtacccagaccccgaggacgtcttcagccgcgagcccttcgtggtcaagttctcgggccccgggaccggtgagcgggccccgcccctcccctcccgccgagctctgacgcccccaccccttcccgcagcagcacagaacctggtgctgatcccgctgcacgcggcgccgcatcaagccgtggcggagatcgacgcgctctacgacgtgtacctggacgtgatcgacaagtggggcaccgacgacatgctgttcctgggcgacttcaacgccgactgcagctatgtgcgggcgcaggactgggccgccatccgtctgaggagcagtgaggtcttcaagtggctcatccctgacagcgccgacaccacggtgggcaactcagactgcgcctacgaccgcattgtggcctgtggcgcccgcctgcgccggagcctgaagccccagtcggccaccgtgcacgacttccaggaggaattcggcctggaccagactcaggctcttgccatcagcgaccactttccagtggaggtgaccctcaagttccaccgatgactcgaggcctgactggggcatgccacctgcagaccctggctctgaggaatggcccaacagtggccccttcagggtggcagccacccttcagtgaggccccaaggcagagtcggctgggcgtggaccaggggcatggacacgtgatgtgctgctctgtacctccgttccccatctgtgggacgggctggatc

SEQ ID NO: 401935 - DNA, 302 bp, Homo sapiens
gcggccgcggagggaaggggtgggtcggtgggtctgacagcgggtctgcgtaggcggcagcgtctgtccctcccagcctctcgctccgcgccatgggcgggccccgggctctgctggccgcactctgggcgctggaagccgccgggaccgccgcgcttcgcatcggagccttcaacattcagagcttcggtgacagcaaagtgtcggaccccgcttgcggcagcatcatcgcgaaggtggggcccgggccggggcggggcggcgtttaggggtgctgaccgcgctgacccccgcacccgccg

SEQ ID NO: 401936 - DNA, 505 bp, Homo sapiens
cttgcttttttgtcttttttttttaaatgtatatttttatcttcatcataaagtggagacatcttacccctttttctctcaagaggaaagaaacaggaggtcatttgcatcatggctgtagcccctgagtcttacatgtctcttgtattgcaactgctgcctccaacccaattaacctctgggttcctgtgaaccatatgaaattgccgtttctagaggccataaagggttagagatcggcaatcacatatggttcagcctaatagcaagttaatggccctccattttaatgtggtatcttttagcttatcattgatctgttgttcatggctcaaagataggatttttctggtgactcttctgtctgatgacagtatggctcaacaaaatacaaatgtttttccgcagtccagttgagaggcaaagcgtatccctaaaatagtctgccagctttaacgctggtgccgttgcgtatgtgcatttgctcacagctgtaacatttgta

SEQ ID NO: 401937 - DNA, 396 bp, Homo sapiens
tgagatagactccaacacaataatggttggggacctcaaccattgtcagcatcggacagatcatgtagacagaaaataaacattggattgaaactgcgctttagaccaaattggcctaacagacatttacagaacattttatctaacagctggagaatgcacattctttttatcagcacatgtaacattctccaggatagaccatgtgttaggccataaaacaagtctcaacaaaattttaaaaatagaaattatatcaagtatcttcttagaccacaaaggaaaaaactagaattcaataacaagaacaactttggaagctgtacaaatacatggaaagtaaacaaaatgctcatgaccaactattgggtcagtgaagaaattatgaaggaaata

SEQ ID NO: 401938 - DNA, 497 bp, Homo sapiens
ggggctggaacacgggaaggtctgaaagcgcctccgcgcgtgtagaggggcagtgccgcggaggagcgcctcaggaagggcatgccctcgcagcacgggcttttgctgtgtcacgtgtcagaaagccacggtgaccaccaccccgccagggaggccagaagaagttctgcggcgacaattctctaaagcagggcttaagtccaggctcggtactgacagccgtgtcccttcttgggtcaacactggggctaactctaccatgtctcctcccagcaaccccgaaagtcgcatgggggacacgaccctctgtcgagctccacaccgacagtctgaccgggggcgggaccagcgcctggtctcgcggctttgctgtcgcctcccgcgcccacgggcacctccgccaccgtggcagccgtcacggagcccttccgcgtcccgagcgccaaggcacctgcgagcagccgctccagggctcgagattgggtgacaagcggccg

SEQ ID NO: 401939 - DNA, 401 bp, Homo sapiens
agttagatatgctggagctgaagtacacaataggagatctaaaatatttaagagaaagctttaacaggagactccgttatacaggaaaaaaaaaatcagcaaatgtaaaagttatttgaaagttcctagttagaatttaaaaaaagaatgcgagtgaataaagcatttgtcccccatatttcataatcaatggtaaggatgtacaattttaggaggttcatgagaaagaaaaaaatttttaaattgtttaaagatataatgtcttaaattcttcccaatcttggaaggaatatagatattaaatttaaaagctcaaaatgtctatagcaagaagaatctaacagaaattgtccagaacacattataattaaactgccaaaattcaaagacaaacaaaaaag

SEQ ID NO: 401940 - DNA, 560 bp, Homo sapiens
gtgttgcattcactgagctcatttgtctgttttttcattatgcaaatctcctcttacctcttcagagtgaccttcacagacaacctagtgaaagcacacttgcacccagcatactttctatcaggccaccctgttttccctaattatagcatatatttcttttattttcttgtttcttattgccaaacattctagttccttgaaggcaggactccactggtctgttctagcactgttcaatagaaatattgtgtgagacataaatgtactttgaaaatggctgggtgcggtggctcacacctgtaatcccagcactttgggaggccgaggcaggtggatcacttgaggtcaggagtttgagaccagtctggccagcatggtgaaaccccatctctacaaaaatacaaaattagtggggcatcatggcgggtggctgtaatcccagctacttggtaggctgagggaggagaatcacttgaacctgggaggcagaggttgcagtgagccgagatcatgccagtgcactccagcctgggtgacagagcgagaccctgtctcaa

SEQ ID NO: 401941 - DNA, 396 bp, Homo sapiens
gctttctaggtaagtgggcacccagggccaggacctctgacccaggatctcttggcgatgcccactgtaccccctagcctcggaagccaccaatggggggggttctacaagtgcactgcctggtgacggtcactggctattcactgtgccttcgtagggcggcgttactggtggttctaattcatgggatgaatcttgttgagttcccagtggtctctctgcccagccccctgtaccttattgccaccaaggcccacacacaattggtgtgtggaagcatcaagtaaccccagattcacagcaggggaggcctctgcggagttaggggaccattggccacatccaccactagggcccggggactcccacctttgaccctgaatgccccacacctct

SEQ ID NO: 401942 - DNA, 428 bp, Homo sapiens
caataattttgtaggtacttcctcaaatttaactcaatggaggtttagattgggtttagattgagtcattagttgcaggtcatttgttgaatcattgaatacttttggttgttaaggtgactgaaatactcagttgatgtcctttaagatcactgaaaatatttaaaatcagcttacatatggtattttggaaatgccacatacgtaatggattaaaacccacaactatatttgctgcctttcctatgcatgtcctgtcaaaattattttttggtggactataagccctaaaacaacatggaccttgttttcctctccattatattctcattacttatactcagcattgtttaaaaaaaagtttgttgatgtaataaatgtgcagttgatataataatgtaataaatgtatactgccataacaaacta

SEQ ID NO: 401943 - DNA, 423 bp, Homo sapiens
ccacctagccggccaggagtatgggtttgccagaggcatgagatgtattgaagcagaaaaggaagaaaaaagattaaggagacaaattgttcgtgataaggggtttcctgataaactcagaaacagcaactaccagttatggagcacttaaactgacactatctcattaatcctcacaacggtcctgtgcaggtggtggttttgttttttaccatcctaaatgccagagctgcacttggtatgtaacaaaggcagcatttgaaccctggcctgctcataccagagcgagggcatctaactgcacccacaaaggacaatggaggaagactgtgtcattgtaatatgagcaaatggggaaaagacaaaacaaatgctttcattatgcccaggttgtaaatgtataaacataaatgaaacacacat

SEQ ID NO: 401944 - DNA, 605 bp, Homo sapiens
aagaaaagtgaaatcggtccagtgtatttaaactactggctgagtatatgtttgaaatctggatctgcctaacaggggttcaatggagtttgcagttgggctaactgggaagggaaataattttgatcgtttaaagaatggaacagaaagcaaaggaaagatgaagcccacttcctatcaatttgtctcaggttcttactgtatcttcccctcatcttgggcaaatatttttctaccctttggccgaaataggtcatctcctcttctattagccatggcctcaaattaggtttaagacagtctgggctgtgaaagatcagaatttgtgtattgcacccgagccactgataactgccaaaggctaggagttccattcaacatcctcaaagatacaaactaagattaatcttaaactcattattttaacagagaaaagggaacacggtttggggttcatttaacatcaccattttctatgttgtcaggaggactaatcattttaaggccaatttggcagttctcactcgtgagaaacaaaactctgctgaaataaatgaagggctttgtatgtgtaaaaatgctagacttcttgaggacagatgaga

SEQ ID NO: 401945 - DNA, 411 bp, Homo sapiens
ctctcctatactctccaatttcatatcactcttttaaaaacttgatgccttaaattagaagatgcacactttgccaacaataatagaaaaactttcagctctccggactatttcctatcaagtgagttctccaaacagcagtttcatgtgagtaggcactctagagagatttctgctattatctctgctttttgttttcataaatctcttgccttttatatttatagtttccccatatattctcctgtcatttcccaagtctcctctaccttcctgagcaactggttctcacctctcagttttctgttttggataccatctatcttgcacccaggagggcctcagtaagtacctgttgaataactgagcacactgagtttgcaacataggaaaataacacacgtgtaagcc

SEQ ID NO: 401946 - DNA, 479 bp, Homo sapiens
gtggggcatggcaagcagaaactaaatatgctatcagaacaagaattttggaattagagcacacagtggtattcagcttggcgtccagtaattagaccattaaggattggattgaggctgaggatctagagctctaaaaatcaagtcagaatttctcttaggagttagggatgcccagattctgtggatgtgtttaaagtggcagcaactgcaaagaggatcgctgcagagactgggcgtgaggctgccattagttgcttcatttctcagtcacctgtaaccattcttcattccatgatactagatctactattccctgataaatcagctgaacagacgagcctaccaaactcatggtttgatgccctctgcaataccaagtttcatctgtgtccttatggctgataactgacttgcatatctagcttcccgacttctggcttaatcttaacctcttaaatttgcctgcccctacaaat

SEQ ID NO: 401947 - DNA, 325 bp, Homo sapiens
ctgcgctccagcctgggcaacagaaccagaccccctctttgtatttcttacaccaacccaatgagacaagtaccactgacccaattctatatgtataggaaactaaggttcacagggagttgtccaaggtttcagtgattagtttacattcctggttctgcagcctatacaagtttgtctgcctatatctatattttttcctgcctccaaagcaggtgacacttggatatttacacagaaatttgtcaggcagttgtttggtaagaggaccagagaaacgcactgggctggagtctgtgacagagtacagccttgagagaagtac

SEQ ID NO: 401948 - DNA, 2682 bp, Homo sapiens
agcggagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgcctttgttggcacctcagattaatcatataatagctatagtctcttcagcattttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaaatggtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatggtagtgagtcctgcatggggtactcgatgtgtaatgaaaacctggaaataataagataataagaaaagcaataattttctaaagctgtgctgtcggtgatacagagacgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtgtttacaaatatgtgccattgtgcaacatcggtggattttctaaaaataatgtaaatgtcttctattaaatgttgagtgcaataaaatccagaa

SEQ ID NO: 401949 - DNA, 1344 bp, Homo sapiens
agcggagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcacagaatatgatgtaataacttctatttattgatcatttattgatcatgtattcagataaatgtatatgtatcatgaatttttatggattaatatattgaatactttcattgacgttaaataagaatattaagattttaaatgttaccctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagccttt

SEQ ID NO: 401950 - DNA, 1151 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggtataa

SEQ ID NO: 401951 - DNA, 1455 bp, Homo sapiens
cagttttacactttttattcagtaggttgttatttctgtattgtttgcttcatattgttttctaagtataattaaaaccagaaaggttacctttttaaataagccagctacaacgggacaaaaaattcacaatactaggtagttgggagtcagaagctgttttcgggaagacctgaaaagggaaaattaagtactaaaaatgtaagtttattttgccatacccctaacaacattttatttaaattatattgtgacttgattacaaatcttttaaatgacattattggcatatttttcttaaactttgtaagaaaaagataacatttcacattttagtagcaaaatcattgttaagagatagtcaattttgtgaaaatatttgagtgctaatcaatttttccaggatgatcttctatcctttaatatttagatacttccttttgaagcacttacatcatcatcaaatttttggtcatttgttgtgtcatctaatttctgtttcattttctaatggcttcgtatgtgaatgaattttagttattcctaacgtcattggtagccactcttttgaattttttttttaaacaagtctttcaattttattttataggtaatttgcattgtatatagatgatcgtctcaaaatttcacaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacacttccattgaaaaagaaaagaagtaaacaagtgtcatttgtaatttgaaatgttttaagttaactgtcatgttactgtccatgaaatggatctggtgacttaggctctatctcctgacattgatttctttctcctgtgtcctcaattatttcttctcctgttaatgcccactggtaataattctcaaaatcgattgctcagaatattccattgtaaaatgcaccttggaaatggttgttttcctcatttgtaaattgaagacaatgcctattcctcaaggtggttgtgagaaccagtcaatgttgcatatgtgtaaacagccagcacatggttgggcattcagtttccctttatcattggtagaataagaatagtaatactcaaccaaaacgtctcagtcaggggttaaaaacttggaagcactgaaactgtgcttcctattcctacttaggtcaacagattgcaaaacaaatatttcagtcctttatcctttgtaatgaatgtgtctttgtgaaatgagtatagtggagcctgatttattctattgagatcattgagggggcaaatgcaaataattataaatgttgcacatgagtgaagccgtaagaat

SEQ ID NO: 401952 - DNA, 962 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggtaggcaagtacacattttatgttttttgttagtggtgataaaatgctggaaacaattatttttgctttaataatatctatctcaatagtatatatcttacaggagacttttctcccttaaatcatatatttcattactgttaaaattttaaatggcttatttttccacactctttcatgtcaatttacttttatcaatgaataagtgtatatctcttacacatatatcttttgataagtataataatttcatgtgtgtttccagatttaaagtacttcttattctgaacttagaatttgaatagataatatcctagtctgtttttagatatggtaattatagccatttttcattaacattacacat

SEQ ID NO: 401953 - DNA, 416 bp, Homo sapiens
  misc_feature (391)..(391): n is a, c, g, or t
acatctgtagctgtcgttggtttgatcttgttgactatgaggaagttctaggaaaactaggaatctatgatgctgatggtgatggagattttgatgtggatgatgccaaagttttattagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattagagacaangcatggagacacacggggaggaacg

SEQ ID NO: 401954 - DNA, 579 bp, Homo sapiens
ctcgctgccctacctggcccacctgaggataatcctgtagaagattcacaggtaattgtagaagaagtaagcatttttcctgtggaagaacagcaggaagtaccaccagaaacaaatagaaaaacagatgatccagaacaaaaagcaaaaggagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcaggtattctgagacccttctccttaggacacttttttgatgttcatgtgttttgtgtgattgaattttttactcctcactattttccctttctaatttctctacagaatcagtttctcatgtatatgcataagcaagaaatacaattatcactattgcatgctgctgaatttagtaacatttttttctgctccccctccatatgacttctctctggctttgaaaagaaaataaacagtaacacttttgtcattg

SEQ ID NO: 401955 - DNA, 430 bp, Homo sapiens
agcggagtctcaagctctggtaggcaagtgcatgcagtgtgcctaaaacctgccagcagtacttttgagttttttttttggtttggttttactttagcatttattattcatggattgaagaaatcaaaatggctgaagataaagaatcaatgtgaaaccagttactgtcttgtactgaagattatttgaaggactgtcagggattctgcctgaaagtttcatcataaatgacttcccaccactcagcttttctgacttcctgggcctgctcttgctgagagatctgtgcactcgataggcttttcctctgtcaccactctgttgctttgactcattgggttagattgtgtctgaaatgtagagttttgtgcatagagctagaaaacttaattgaagttgttagaatcacatctaaaataaaaatgtaaac

SEQ ID NO: 401956 - DNA, 5208 bp, Homo sapiens
tcgcggaatactctgctgctcgcggaattctccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401957 - DNA, 4679 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattc

SEQ ID NO: 401958 - DNA, 5302 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggacacgcagaagatcctggtggactcccgggaagccacctctgtgccccacatctacgccattggtgacgtggtggaggggcggcctgagctgacacccacagcgatcatggccgggagtgaatcggttgagccgacatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401959 - DNA, 4874 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401960 - DNA, 5128 bp, Homo sapiens
agcggagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401961 - DNA, 4916 bp, Homo sapiens
ctcgctgccctacctggcccacctgaggataatcctgtagaagattcacaggtaattgtagaagaagtaagcatttttcctgtggaagaacagcaggaagtaccaccagaaacaaatagaaaaacagatgatccagaacaaaaagcaaaaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401962 - DNA, 5044 bp, Homo sapiens
agcggagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401963 - DNA, 3015 bp, Homo sapiens
  misc_feature (53)..(53): n is a, c, g, or t
acccaaaactcgcccaaggtctcaagaaccaatgcaaaaacaaaaaaacttanggacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401964 - DNA, 2949 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgcctttgttggcacctcagattaatcatataatagctatagtctcttcagcattttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatggtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatggtagtgagtcctgcatggggtactcgatgtgtaatgaaaacctggaaataataagataataagaaaagcaataattttctaaagctgtgctgtcggtgatacagagacgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtgtttacaaatatgtgccattgtgcaacatcggtggattttctaaaaataatgtaaatgtcttctattaaatgttgagtgcaataaaatccagaa

SEQ ID NO: 401965 - DNA, 2892 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgcctttgttggcacctcagattaatcatataatagctatagtctcttcagcattttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatggtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatggtagtgagtcctgcatggggtactcgatgtgtaatgaaaacctggaaataataagataataagaaaagcaataattttctaaagctgtgctgtcggtgatacagagacgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtgtttacaaatatgtgccattgtgcaacatcggtggattttctaaaaataatgtaaatgtcttctattaaatgttgagtgcaataaaatccagaa

SEQ ID NO: 401966 - DNA, 1448 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaaaggtagaacacttttttttcaagttttaggataaaatataatcaatgacttctaattactgaagtttttcttaaacccctttaaaactgatatttaacttttgcttagatttttaaaagttgaagcttaaagcttcaattaaagcaaattttttcttaaaatagataccttgattttggttcaaagcacttttcagggaaactcagaatatacaaatttcttataaatagtgagtcaaatacttgaggaaactagttttactatattcttctgcttagggtgctatttgttaaataaaattcaaacaactgatgaaatattggacttgataatctatcacaggctcatgttcacacatgaactctgtaattacagtgagcaaaacacaattcttagcttctgtaccaggcattggcaaacttttttttgtaaatagccagagagtaaatatttcaggttttctggatcgtacagactctgttcagctactcaactctgccatcacagcgtaaaagcagcctttgatagttcctaggtgggtcagaacataagctgtg

SEQ ID NO: 401967 - DNA, 2820 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgcctttgttggcacctcagattaatcatataatagctatagtctcttcagcattttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatggtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatggtagtgagtcctgcatggggtactcgatgtgtaatgaaaacctggaaataataagataataagaaaagcaataattttctaaagctgtgctgtcggtgatacagagacgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtgtttacaaatatgtgccattgtgcaacatcggtggattttctaaaaataatgtaaatgtcttctattaaatgttgagtgcaataaaatccagaa

SEQ ID NO: 401968 - DNA, 1444 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggtaggtaatttgcattgtatatagatgatcgtctcaaaatttcacaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacacttccattgaaaaagaaaagaagtaaacaagtgtcatttgtaatttgaaatgttttaagttaactgtcatgttactgtccatgaaatggatctggtgacttaggctctatctcctgacattgatttctttctcctgtgtcctcaattatttcttctcctgttaatgcccactggtaataattctcaaaatcgattgctcagaatattccattgtaaaatgcaccttggaaatggttgttttcctcatttgtaaattgaagacaatgcctattcctcaaggtggttgtgagaaccagtcaatgttgcatatgtgtaaacagccagcacatggttgggcattcagtttccctttatcattggtagaataagaatagtaatactcaaccaaaacgtctcagtcaggggttaaaaacttggaagcactgaaactgtgcttcctattcctacttaggtcaacagattgcaaaacaaatatttcagtcctttatcctttgtaatgaatgtgtctttgtgaaatgagtatagtggagcctgatttattctattgagatcattgagggggcaaatgcaaataattataaatgttgcacatgagtgaagccgtaagaat

SEQ ID NO: 401969 - DNA, 585 bp, Homo sapiens
  misc_feature (554)..(554): n is a, c, g, or t
  misc_feature (556)..(556): n is a, c, g, or t
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgactncntgatgggctgctacgctgtgatggggggg

SEQ ID NO: 401970 - DNA, 672 bp, Homo sapiens
  misc_feature (647)..(647): n is a, c, g, or t
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattagagacaangcatggagacacacggggaggaacg

SEQ ID NO: 401971 - DNA, 1296 bp, Homo sapiens
agcggagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcacagaatatgatgtaataacttctatttattgatcatttattgatcatgtattcagataaatgtatatgtatcatgaatttttatggattaatatattgaatactttcattgacgttaaataagaatattaagattttaaatgttaccctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagccttt

SEQ ID NO: 401972 - DNA, 965 bp, Homo sapiens
agcggagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaattt

SEQ ID NO: 401973 - DNA, 919 bp, Homo sapiens
agcggagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggtataa

SEQ ID NO: 401974 - DNA, 5360 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401975 - DNA, 4976 bp, Homo sapiens
  misc_feature (4866)..(4867): n is a, c, g, or t
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcacnnttttctccccaggtgttttttcccacttcttctggttttgtctctaccttggggggccacatttccctttgtccttgcgcacacgtgtgctcctccttctcgcttgccc

SEQ ID NO: 401976 - DNA, 5303 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401977 - DNA, 4014 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401978 - DNA, 5166 bp, Homo sapiens
tcgcggaatactctgctgctcgcggaattctccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401979 - DNA, 5405 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401980 - DNA, 3072 bp, Homo sapiens
tggtcctgcagtttgtgggcctgtgtgcggcacaaactgcaggctccgaatgcacctgggcttggtgattcccaaggaaggctgcaagattcgatgtgccaacgagaccaagacctgggaggaaggcaaggtgctcatctttgatgactcctttgagcacgaggtatggcaggatgcctcatctttccggctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtcaggaagccagctcttcagtcttggagatgatttctgctacaattctgtagaaagattaaggatggcagagtaaaaggttaccaagaatgccaggatgtttttcttgggcgtaggaggtccagattactttcctttttgatgaaagagtttggaagactgtcccatctctctggcttgagaaatctctgccattttaaacatcactgtgaaatagcaattattatcatctgtatttagttttaacattacccacaacatagaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagagaaggcaaactcttgaaaagtaaaaaggtgtttgtgaccttcagtatttattgaacagaggaaataactgacaagggcaatacaattcaatgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggtatttaaaatcaggtcactacagtaaggttctaagtattgccaattgaaaagctagaaatggtattactgttgcaaagtgttgtcaataattgactccaatagcattgtaaatacttgtatcccacaactattttaaacccaagcaataaaatggattttctaattcacttcaattctttatttctcttacctatctatgtcttggtacataagaaaagtgtttccatcactgcattggtagaattatttcagtgttattatttttgtgatttcgtatgtctacacaaaaatgaattagtttaatttatattgtgatacagttgtttgagaaatatttttaattctgtttcaactttatttctccaagtgtataatataaaaattacttctgttattgttctctaccaataggggaaaaaattaaaacattagatccattgagaaagagatgatgtaataaataattaagattagtaataatattatcaggggtgattatgaccagttgaataatctctttcccttgaattatttagctaacaaattaactctcccaaatatttaaaataatgtaaaatcatattttactgcccattattaactaaaatatttttgtttgactttgagcaccaactggtaatactaataaatacccatgtcatgcagatggctgggcgaataagagatgtctaaaaatatgcactggtcttggaaaacatggcacaagtaaggatatcatatatgatgtctgtttattttatgtctgatttcttttgaatgagtagttggggactccatttctaaggagactaggtaaataaaatgacctttgacatttcaaaaaaca

SEQ ID NO: 401981 - DNA, 2857 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagtatgggtcctctgttatccgtcatatccgtcacctcagaggatgagagtttgttacaacacagttgtgttcctttggattacttatcttcttttgtagctgaagtagactggagcaaagtgatattaatccaaactcttaagtctatatcccttcttggtgctttctattagcctggagacattgcccagctctagggctgccctcctccattatttctcggcagagtacttatctagttgaggagctgccttgtttctctctctgggtagacagatgtgcattcagagtcagccaacatgcattgagccctgcagatgttatgcattgtgcttcctgctttgcaacttgacttattcatgactacaagaagtacccctaactgaagaactcaccccatgatatttatacgttttgatatagaggagatggtatggtgcaatggaagctggctgcctttttcaaatcccagctctaacacctaacctgtgtaaccttggctagttacttaatcc

SEQ ID NO: 401982 - DNA, 1065 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgagaactggagg

SEQ ID NO: 401983 - DNA, 1172 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggtaggctattggagttgcatttcaagtctacgtgtgttactctctaatggctcatcctttttctactaatttaattattatctacatcagaatataagtgataggaccaatttcccattatgggtttgtcagaaagggtagtattttctatcttttactgtttcttgaattctgtactctgcatagccttgattagtactttttgttttcttagcagttgaaataacatccttatctcttctttcatcataatcattttaaatgtgtatgtgtttgctaagtcagacttctatatagcaagttaaccattttcctaggtagagcaagggctctggggagataaagattgatcagaactaatctgagccaaaatttctgcctgttcttctgtaattttttaatgtactttgtgttaaagaaatgataacaattgccaaaattttttttagtactaatgctgtatttgagaaagctgtttaaaaaattgctgtacattaacattattatgtttctccacagtcattgtccaataatgaattagaatcatgtagattttaggatgcttttttagggagttgaatatatttgactttttgaaatg

SEQ ID NO: 401984 - DNA, 2342 bp, Homo sapiens
acatctgtagctgtcgttggtttgatcttgttgactatgaggaagttctaggaaaactaggaatctatgatgctgatggtgatggagattttgatgtggatgatgccaaagttttattacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgcctttgttggcacctcagattaatcatataatagctatagtctcttcagcattttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatggtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatggtagtgagtcctgcatggggtactcgatgtgtaatgaaaacctggaaataataagataataagaaaagcaataattttctaaagctgtgctgtcggtgatacagagacgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtgtttacaaatatgtgccattgtgcaacatcggtggattttctaaaaataatgtaaatgtcttctattaaatgttgagtgcaataaaatccagaa

SEQ ID NO: 401985 - DNA, 598 bp, Homo sapiens
atatttccaagagatggcagataggtccctgggggcctgtggccagcctggagagggagagaccaagccagaggctgtggaaagctctagagactttgtactagaaaggctgctgttggtggcagagcttacatggccagggatcccggaggacctggaaggggttttaatggacttttgagaatcaaagtgaactgccagggacaaacaagagtggcgaggaaatggaagcagtcataccactcaggctggaaaatcgctctaggaatggcaagaagggctctttctcacttggatggtctccagaaagtcagctgccatgtcacgaagtgccctgtgagaaggacctgtaaggagggacggagggaggcctctaaatgacagccttcgaggaactgaatcctgctggtgaccatgtgagggagcttggactccggtccccctgtgttgagccttcagatgagttggcagccccagctggtggcatgactgtaacgtcctgaaacaccttcagccagaaagcattcagctaaaccacacctgtatttctgacccaaagaaattgtgagataataaacatttcttctcttgaaaaaaa

SEQ ID NO: 401986 - DNA, 711 bp, Homo sapiens
catcaagaatggtccaggttcttctagatgatctgcacaaatggttcctctcctcctgcctggtgtctgccattagcattggaataaagttcctgctgaaaatccacatctcccctgggtccggtgttctggaagcgagagagacaatgtcacacttcaaggaggcagctctctagacaggaaagttattcacgtcccatgtcaattgagaaatgcaattttatctgctgcctttcattctataccctgcttctgaaccatcgtgttcaactgtgaaactcacactttggtgaccacgactccaaaactcacttaatacacccaaggtcagccccagtgatctgcttcatagcaaggactttgggtgggtctgcccagggagtagggcaccctcagagaatgtggctttggactttatcacagctggggccttttgtgtcacttaagatctaaacttgtaaccatgctagatgtgtttctaatgtgacaacatcacgaaccacgagtccagaagcctaatccttaatcctacctcctcatgatgaagtctcatgctctgtgctcaacgtggttagctgcacaagatgtaaaccaaagcttcactgaaccctcgacccaaatcagtaactcaagtgcgtcaatcataatgaacctccccaaactcagtttttatgattatttttgaggcagggtctcactctgtcgcccaga

SEQ ID NO: 401987 - DNA, 836 bp, Homo sapiens
gcgcgccgcagccccgcgcgtccggccgccgcccgcgcccatccagcagcctcgccggagccacaccgcgggacagacgcggccgcggcgcgtcccggcccggtccagcccagcccagcccagtcccggcaccgggcggcccggcggccggcccgcccccgagggcgccgggcgcggcgggaggatgccgaagccgacgctgctgctgcgcgggggctgggagcgcgagcgcagccccggggactcggagctgggccgccagttccgggactggtgcttgcgcacctacggcgactcggccaaaaccaagacggtgacacgcagcaaataccagcggatcgccgaggtcctgcagggcggcggcgggactggcgcgggcagcggccccgcagccggcgagaaaggcaagttccagttctgggtgcgctccaagggcttccgcctgggcagcggccgggaacccaagatgggccaagtggtgtatgtgccggtcaagacgggctcgctgtgtagtattcaattttatggatgtaccataatttacttatccagtcccctgttaatggacatttggattgtttatgatattctgctctcgcaagacttcagtgaacatccctgaatatggatggccatttcaagcatgggcgagtttataccaaggagttgaattgctgcgtctgagggcatgtgcttttggagatgatacagactgccctccacagacagggaaccaattttcactcccggcaataatgtctagaacgtgagccattcgtgtgatgaccgaggttactgtatattgagcattcagtgtatgctggcactgtgcatcc

SEQ ID NO: 401988 - DNA, 336 bp, Homo sapiens
gccccagcgttgggagacttgaaaggaatcaccaaccaagttaatgcaataaatttccatatatagatcaattggatgttttgtccccagcttcctaggcctttaataaactgaattgttttggtatcactggatgaaaggttctgtaaaagttcaaagtattgttatttggggcattcacacctgcatgtttaaaatgcctttgtgcagaatgtagtccaatctgctttcaaatcagaccttcaaagaagggtagattcatccatgtgacagatccccttaggtgcttctctaaaagaaaaagttaagctagcaggtctacccccactcattatc

SEQ ID NO: 401989 - DNA, 614 bp, Homo sapiens
accctgtctcagggaaaaaaaaaaagtactttgtaatctgtaaggtttatttcaacacacacaaaaaaagtgtatatgctccacaatgcctgtgaatatacacacacacaccacatcatataccaagcctggctgtgtcttctcacaaatgcgctgctaggcaccacccccagttctagaatcacaccagccagttcaccctccagatggttcaccctcaacttcataaaagttctttacctaatctactgacaggctcatccctgacctaattttaaagatttcctaggagctgcaatgggaatcctggacctcagcctggacaaagaacagctgcaggtcattctcatgtgtggacacggaagccctgcctgcctttgctggccagctgggctgagtgggcctgggaaattaaggctgcagggttggtcccaggcagtcttgctgaagcttgccacatcccccagcctcttggatttgccaggatccaagagcatggactttaggaattcctggtggaggagtgaagaaaatgtgacagggtgtcctaagcccgatctacaggaagaaaactggaaataagactgaggacttagtttaagatgttcctactc

SEQ ID NO: 401990 - DNA, 271 bp, Homo sapiens
tgtatgttcaatttattgtatgtcaattataccttaataaagctttaaaaagggggggtaaaaatttggataaactttacctctttgcctcttcaaagaaaaaatggtcaataagcacaggaaaatatgctcaatattattagtcatcaggaaagtcatcagtgatatattactttataaccactagaatgacaaaaaataaaaagaccaggaataccaagtgttggtgaagttgtagagcaactgggcgacagagcaagactccatctca

SEQ ID NO: 401991 - DNA, 203 bp, Homo sapiens
cctctgttttgaggctgtgtgcagtttacatagacaccttcctgttacctaaagaacatctctgtctgtctggatccatctcttgtcgatctagaactcgagtggcaggtgggaaaccatcccccagtgtgttgtgtttgtaatttgaaaattgttttcaagaaatttttgcaaaaacaggaaaaatcttttacacattgatt

SEQ ID NO: 401992 - DNA, 471 bp, Homo sapiens
caggtggaacagctgctaaaccttcccagtatttctggcaaaccctttcttttaaaacttcaaaataagatgactggctgcattgttgcttgttggcattttccagttggaagaacagctcttattgaaaagcctcacctgggctccacaaagtgaggctgtcctgactaatttggctaaattaccttactcttggtacctcacagtcagtgaaaagatttacggcaaccaatgatgggaggctgctatgaaagacatggtaaaatataacaacatacagggcgcaggagtgggaaactacatttccccgtcctttcccagtggaaaaaaacaaccaacaaacatttgggctatgagttttttaaagaatgagctgaatgtttaaaattaattatttacatattattacttggcctatctctagatcatctgtaaaaattatgaaataaaagcttaaaaccactatttatc

SEQ ID NO: 401993 - DNA, 510 bp, Homo sapiens
cttctccagctttctggcaataccaaggggcagacccgggaatgggttgttcagtcactgccgtaccgcccatgagcggcagagggcagcaaaacacactcatcggacgggcatcaagggagcctgaggataaccagagcttgaaaatgcaatcaacccatgaaaatgtttttaaagaccatgattctgttcatcaaggagacatttaaagttataagaatcatctgaagtatgaatgaatatcgtaaggatttcaccaaatctatacagttcattccatcgtcaacatctaaaacaatgctgaaacagagcaagctttccagtcttactttacgagcaaaatcaagatctacatactacaactttcacttacgtttctccatctaacccatcctctctttcaataactgtaactgtttgattgaagactgcatcttggaatacattgccctgtttaagaaaataaaataatcagaaaaatctaaatgcaataaaggaagtaaaacatgt

SEQ ID NO: 401994 - DNA, 5953 bp, Homo sapiens
  misc_feature (1898)..(1898): n is a, c, g, or t
tttgcttctattttggattcctcgtgcgtcttgagaccaagcaggaatatgcactggtactttagaaaacatttcatgttgcacacaaatactttcatgatcagctttaatttaagggacatgtaaataaaaagatgcatttgacaggacagcagactagttcaagcaggaggttagaccagtaacaacaaccaagaaagcaaagtgctcgtttccatcttggctttaccacacttacaaactgatacccaaataacagaaatgtttctcaaagctgcacaagaattttaaggattcatgaccccactttcattaaatagtcccagaagatagctaaataacattttcagatagaacctcacactgcataagtttcataacaaacaaacctaagatatgctgacagaaatcacattgagtttgcaagcactcaaatagaaaacccaagacctccggcaacaaattagaaaatatgaacagaaatattttaaaccacaagtatttcatcccaactaaattccaatttcttcaatgttctctgagttgttagatttcaaagtgaagagaactgaaatctctttttattcatagcagagccaaaactggaagtcacttattaaatacctgtgtacaaaacaccatacttggggctatatgcgatttcaggttggataaacgagtcatgttgaatgacaaaaagttagactggggagatttatggagagaagcaagcacctgtgatttgttggtttggcgttacaataaacactgtaagtgaaaatgagtcacaggcagttagaatggcgttaaggaaaccatttaggtctaaaaatcaggactgaagtgatcaacagttaacagatgaagccatgagaactggcacgctctggaaaggctggtgcagagagcaggacggtgagcctgagtgagcctggagttagtcaacagattcctcaacagaaaaggagtgaggagcagggtcaaagaaatgaaggtgaatttggggggtggtggtcaatgggttaaacgtacaagttgaggccgaggaactgaggctgaagaaggttctggcaagtggagaaccatgagatcctgacagagcaggcttttgtgggcagaagccatattagaagaagagctaaaggaaagctgaaaacctggcgacgaaaaggaagccaagaacataggagatattttgacaaaacggaaaaacaacagaacaggaagtgaggcaggagaaccacagagatggaagccaggaggtgtccaattagacgggcacaagagaaaaacagccagagaccgagaaaacggcgggaaggaaaggttccatctggagaaaaaagcctctcaagactggaagggacaggagctggtgaccatgaagcagttcagactcagctctgagccccttgtgtggaccacaagcagcactgcaaagtcctcgctgtagagagaagaccatagatgcacacagacggggttatcccttgaaaccagatccgggaagccatcagtcaaaaagcctgtgtggtcacagatgcttactggtggttcctgaaatgagtatttctaggcagggggcttcagtataaaccagatgtgtgctagctgggtggacttcaagtaaggagtcaagacaaaacacttagagtgaccttttggccactgctgtgtctgcaggctcagcctgctctagatctgattcccacagtggagggacaaagggccagcagcttgtaggaccaaatgagaaaaatacataatcattatgttttagccagaaaaaggcaacttgattatgaactggatgacatatcaaatgcaaggccttaaaatgcattcactctaataaactgctctgtagaattcaagggaatgaaatccgcttctcatangtaccaaggaccaactgctttgaatcttccactgtggatgatggcaactggtccttttaggagagccattttccagacagtcttgtctttatttatttattttttaattgttagtagcttttacttattatttatgtacttattttttgagacagtctcactctgtcacccaggctggagtgcagtggtgcaaccttgactcactacaacctcctcctcctgggttcaagtgattctcctgcctcagcctcatgagtagctgggattacaggcgtgcaccacctcgctcggctaattgtttttgttcttttttgagatggagtctcgttctatctcccaggctggagtgcagtggcacgatctcagctcaccacaatctccacctcccaggtttaagcaattctcctgcctcagcctcccaagtagctgggattacaggcatgcaccaccacacctggctaatttttgtatttttagtagaggcgaggtttcactatgttcgccaggatggtcttgaactcctgacctcaggtgttctgcccaccttggcctcccaaagtgttgggattacaggtgtgagccaccgtgcccggcctttttgtattttttagtagagatggggtttcaccatgttggccaggctggtcttgaactcctgacctaaagtgatccacccacctcagcctcccaaagtgctggaattacaggagtgagccaccatgccctgcccagtctttataaatgaagcttgactctggactgtgatagcagaaacaaatacaggcagtgcctcagagaatacaaaatatcaagcaaatcctaagtgttgaagctagaacccaggtgagtgcactctgcattactgagaatgtgctccctgccaaaaggctcctaccctattccaaccaagccggaaatggcaacagaccaaacgtgaggagtgagtgcctctgtgctccttgaggctgtttcattacagataacaaggttacctagggcagttgtgaagatgaaatgaggatgtgtgtggaagggcagagcagatgcttgatgttctccatctgaacactactcttgaccacagtatttctcattctcctttctgaaatgcctctaggccttaagcgcctatttctataaatgttgggtgatcagaccaatatggtttctgaaaaaactgttcagaaatagactaattttctttgggtggttcagtctgatgctgaaataaattgcaagatgattttcaaaaataacatgaaccccaacagcttcactgagaaatatggagcctcttcaaacgtgtttttaaaaagaactggatgtgcaggtgtaagagatttattacaaaacaaaaactccccttgccagccttattactctggctcatcattaaaatccagtgctagccatattacatgcccatcttaaaacttttatcctttagttacaaaaagaatactatgtagcttacatattcagaatttacctactaccccaccacatcaaagtccataaggtaccatatactcttccccgccccatgcttcatgggatgttattacagtatggtgctttacagcgaaaatgagagcagtcacttaagcggcttactgagacccaggcaatgttctaagcagctacacacagtaactcctaacaaccttaggaggcaggaaccaaaagctgaagcatcatacaacttgcctccaactaagaggggatctggggttcaaacccaggcagcctgacatgagcgtttcctttttttttttttctcttttgctaagtaaaaagtaggtttaagggaagaatcatttatagtaacactgaattaagtaagggtttgtaggtcacagaatcagactatttagggctgatacttcaagcatatctcaattaacaaaaaagcacattgagactccaaggatgaactgcctttgcttagtggccagggcactgtcaagacccagaggtctcctaattcccacgctagcacaccataccacccctttgttcaacctcacagaattgccaatactagcgtatcaccaggaatacttacgaaccatactaactcacatggaagaatggcaaatgaaaactggcccacattttcttgttccttcttcaaagagtaatagggttctacctaattgtgaactagaagctggggatgaaaaacaagccagatacagagctcacagtccagaaggagatgtcaacaagatgacaggctgccatgggtactgacagaagtctacataagggacagcaggggaacaaaaaaaggcacagtcaaaacatctttgactgcaatttggagactttaaacaaggattatcctttctacaggcatactgaattttctttttaatgcctcactgtgcctattaagcaaaatccgtaatacaacacaccagacagaagccttaccctgtgagccgggcgcagtggctcacgcctgtaagcctgacactttgtgaggccaaggtgggtgaatcacttgagctcaggagttcgagaccagcctggcaacatggtgaaaccccgtctctaccaaaaacaaaacaaaaacattagccaggcctgtggtgtgcgcctgtggtcccaaatacttggaaagctgaagcaggagaatcgcttgagcccaagaggcagaggctgccgtgagctgagatcatgccactgcattccagcctgggcaatacagtgagaccccatgtcaaaaaaaaaagaaaaagaaaaagaaaaaagataaaagcagctttaccctgtaatcttagttctagtactatctggttctgtaacccaagagcagatacttcactctcacctttaacgtgaagatttatctttcaatcctttagagcttgaaaatgcaatcaacccatgaaaatgtttttaaagaccatgattctgttcatcaaggagacatttaaaggtatgtcattaacagaaatttaaaagggtattgtgggtaactgaattatcatagatacaatacagcaagtatatatggtatattcattactgagatgatttgaactttccatattcaatatggaaccttgagcaagctacttaaattcaggttttgtctattccatctacaaaatgggaacagtatcaccttccttcagtgagctgtcgtaaaggtgtgtgatatgatgactagaaaacaaacagaacacagcacgtgattgatgtttaataaatgagttcccttccccctttcttaaactgcagcaaagtggtacccaaacctaagagctattatccctaaatttcaaaatctaaaaaaaaaaccttagaacctcagatgatataattaacataaaagcccaggtttttgtataaatgaaaagggataaaaattcatacaaaatccattagtaacattcataagcacccgaaataaattatttagatgtttgcaagtcagctgcaaggtgttcttcctcctcaaatatcctctaaggatgagcttatagacagattaacttaacaacgaaacctaacattccaccagtaagaatcttgtttgtgtgtgaagctgctttttactaagttggaggtaagagctcaaagtagagttttacttaagaaaattggggcaaacattgattttagttctacagctataaaatgatgccattcaaaaagtgaacagtgggccgggcacagtggctcctaccctattccaaccaagccggaaatggcaacagaccaaacgtgaggagtgagtgcctctgtgctccttgaggctgtttcattacagataacaaggttacctagggcagttgtgaagatgaaatgaggatgtgtgtggaagggcagagcagatgcttgatgttctccatctgaacactactcttgaccacagtatttctcattctcctttctgaaatgcctctaggccttaagcgcctatttctataaatgttgggtgatcagaccaatatggtttctgaaaaaactgttcagaaatagactaattttctttgggtggttcagtctgatgctgaaataaattgcaagatgattttcaaaaa

SEQ ID NO: 401995 - DNA, 5871 bp, Homo sapiens
  misc_feature (1898)..(1898): n is a, c, g, or t
tttgcttctattttggattcctcgtgcgtcttgagaccaagcaggaatatgcactggtactttagaaaacatttcatgttgcacacaaatactttcatgatcagctttaatttaagggacatgtaaataaaaagatgcatttgacaggacagcagactagttcaagcaggaggttagaccagtaacaacaaccaagaaagcaaagtgctcgtttccatcttggctttaccacacttacaaactgatacccaaataacagaaatgtttctcaaagctgcacaagaattttaaggattcatgaccccactttcattaaatagtcccagaagatagctaaataacattttcagatagaacctcacactgcataagtttcataacaaacaaacctaagatatgctgacagaaatcacattgagtttgcaagcactcaaatagaaaacccaagacctccggcaacaaattagaaaatatgaacagaaatattttaaaccacaagtatttcatcccaactaaattccaatttcttcaatgttctctgagttgttagatttcaaagtgaagagaactgaaatctctttttattcatagcagagccaaaactggaagtcacttattaaatacctgtgtacaaaacaccatacttggggctatatgcgatttcaggttggataaacgagtcatgttgaatgacaaaaagttagactggggagatttatggagagaagcaagcacctgtgatttgttggtttggcgttacaataaacactgtaagtgaaaatgagtcacaggcagttagaatggcgttaaggaaaccatttaggtctaaaaatcaggactgaagtgatcaacagttaacagatgaagccatgagaactggcacgctctggaaaggctggtgcagagagcaggacggtgagcctgagtgagcctggagttagtcaacagattcctcaacagaaaaggagtgaggagcagggtcaaagaaatgaaggtgaatttggggggtggtggtcaatgggttaaacgtacaagttgaggccgaggaactgaggctgaagaaggttctggcaagtggagaaccatgagatcctgacagagcaggcttttgtgggcagaagccatattagaagaagagctaaaggaaagctgaaaacctggcgacgaaaaggaagccaagaacataggagatattttgacaaaacggaaaaacaacagaacaggaagtgaggcaggagaaccacagagatggaagccaggaggtgtccaattagacgggcacaagagaaaaacagccagagaccgagaaaacggcgggaaggaaaggttccatctggagaaaaaagcctctcaagactggaagggacaggagctggtgaccatgaagcagttcagactcagctctgagccccttgtgtggaccacaagcagcactgcaaagtcctcgctgtagagagaagaccatagatgcacacagacggggttatcccttgaaaccagatccgggaagccatcagtcaaaaagcctgtgtggtcacagatgcttactggtggttcctgaaatgagtatttctaggcagggggcttcagtataaaccagatgtgtgctagctgggtggacttcaagtaaggagtcaagacaaaacacttagagtgaccttttggccactgctgtgtctgcaggctcagcctgctctagatctgattcccacagtggagggacaaagggccagcagcttgtaggaccaaatgagaaaaatacataatcattatgttttagccagaaaaaggcaacttgattatgaactggatgacatatcaaatgcaaggccttaaaatgcattcactctaataaactgctctgtagaattcaagggaatgaaatccgcttctcatangtaccaaggaccaactgctttgaatcttccactgtggatgatggcaactggtccttttaggagagccattttccagacagtcttgtctttatttatttattttttaattgttagtagcttttacttattatttatgtacttattttttgagacagtctcactctgtcacccaggctggagtgcagtggtgcaaccttgactcactacaacctcctcctcctgggttcaagtgattctcctgcctcagcctcatgagtagctgggattacaggcgtgcaccacctcgctcggctaattgtttttgttcttttttgagatggagtctcgttctatctcccaggctggagtgcagtggcacgatctcagctcaccacaatctccacctcccaggtttaagcaattctcctgcctcagcctcccaagtagctgggattacaggcatgcaccaccacacctggctaatttttgtatttttagtagaggcgaggtttcactatgttcgccaggatggtcttgaactcctgacctcaggtgttctgcccaccttggcctcccaaagtgttgggattacaggtgtgagccaccgtgcccggcctttttgtattttttagtagagatggggtttcaccatgttggccaggctggtcttgaactcctgacctaaagtgatccacccacctcagcctcccaaagtgctggaattacaggagtgagccaccatgccctgcccagtctttataaatgaagcttgactctggactgtgatagcagaaacaaatacaggcagtgcctcagagaatacaaaatatcaagcaaatcctaagtgttgaagctagaacccaggtgagtgcactctgcattactgagaatgtgctccctgccaaaaggctcctaccctattccaaccaagccggaaatggcaacagaccaaacgtgaggagtgagtgcctctgtgctccttgaggctgtttcattacagataacaaggttacctagggcagttgtgaagatgaaatgaggatgtgtgtggaagggcagagcagatgcttgatgttctccatctgaacactactcttgaccacagtatttctcattctcctttctgaaatgcctctaggccttaagcgcctatttctataaatgttgggtgatcagaccaatatggtttctgaaaaaactgttcagaaatagactaattttctttgggtggttcagtctgatgctgaaataaattgcaagatgattttcaaaaataacatgaaccccaacagcttcactgagaaatatggagcctcttcaaacgtgtttttaaaaagaactggatgtgcaggtgtaagagatttattacaaaacaaaaactccccttgccagccttattactctggctcatcattaaaatccagtgctagccatattacatgcccatcttaaaacttttatcctttagttacaaaaagaatactatgtagcttacatattcagaatttacctactaccccaccacatcaaagtccataaggtaccatatactcttccccgccccatgcttcatgggatgttattacagtatggtgctttacagcgaaaatgagagcagtcacttaagcggcttactgagacccaggcaatgttctaagcagctacacacagtaactcctaacaaccttaggaggcaggaaccaaaagctgaagcatcatacaacttgcctccaactaagaggggatctggggttcaaacccaggcagcctgacatgagcgtttcctttttttttttttctcttttgctaagtaaaaagtaggtttaagggaagaatcatttatagtaacactgaattaagtaagggtttgtaggtcacagaatcagactatttagggctgatacttcaagcatatctcaattaacaaaaaagcacattgagactccaaggatgaactgcctttgcttagtggccagggcactgtcaagacccagaggtctcctaattcccacgctagcacaccataccacccctttgttcaacctcacagaattgccaatactagcgtatcaccaggaatacttacgaaccatactaactcacatggaagaatggcaaatgaaaactggcccacattttcttgttccttcttcaaagagtaatagggttctacctaattgtgaactagaagctggggatgaaaaacaagccagatacagagctcacagtccagaaggagatgtcaacaagatgacaggctgccatgggtactgacagaagtctacataagggacagcaggggaacaaaaaaaggcacagtcaaaacatctttgactgcaatttggagactttaaacaaggattatcctttctacaggcatactgaattttctttttaatgcctcactgtgcctattaagcaaaatccgtaatacaacacaccagacagaagccttaccctgtgagccgggcgcagtggctcacgcctgtaagcctgacactttgtgaggccaaggtgggtgaatcacttgagctcaggagttcgagaccagcctggcaacatggtgaaaccccgtctctaccaaaaacaaaacaaaaacattagccaggcctgtggtgtgcgcctgtggtcccaaatacttggaaagctgaagcaggagaatcgcttgagcccaagaggcagaggctgccgtgagctgagatcatgccactgcattccagcctgggcaatacagtgagaccccatgtcaaaaaaaaaagaaaaagaaaaagaaaaaagataaaagcagctttaccctgtaatcttagttctagtactatctggttctgtaacccaagagcagatacttcactctcacctttaacgtgaagatttatctttcaatcctttagagcttgaaaatgcaatcaacccatgaaaatgtttttaaagaccatgattctgttcatcaaggagacatttaaaggtatgtcattaacagaaatttaaaagggtattgtgggtaactgaattatcatagatacaatacagcaagtatatatggtatattcattactgagatgatttgaactttccatattcaatatggaaccttgagcaagctacttaaattcaggttttgtctattccatctacaaaatgggaacagtatcaccttccttcagtgagctgtcgtaaaggtgtgtgatatgatgactagaaaacaaacagaacacagcacgtgattgatgtttaataaatgagttcccttccccctttcttaaactgcagcaaagtggtacccaaacctaagagctattatccctaaatttcaaaatctaaaaaaaaaaccttagaacctcagatgatataattaacataaaagcccaggtttttgtataaatgaaaagggataaaaattcatacaaaatccattagtaacattcataagcacccgaaataaattatttagatgtttgcaagtcagctgcaaggtgttcttcctcctcaaatatcctctaaggatgagcttatagacagattaacttaacaacgaaacctaacattccaccagtaagaatcttgtttgtgtgtgaagctgctttttactaagttggaggtaagagctcaaagtagagttttacttaagaaaattggggcaaacattgattttagttctacagctataaaatgatgccattcaaaaagtgaacagtgggccgggcacagtggctcacgcctgtaatcccagcacactttgggaggccaaggcaggcgtatcacctgtggtcaggagttcaagaccagcctggccaaatgacgaaaccccgtctctactaaaaatgcaaaaattaggcaggtgcggtgacgggcgcctgtaatccaagctactcaggaggctgagacagggagaactgcttgaacccaagaggcagaagttgcagtgagccgagatcgcaccactgcactccagcctgggtgacacagagactccgtctcagggggcaaaaaaaaa

SEQ ID NO: 401996 - DNA, 5721 bp, Homo sapiens
  misc_feature (1666)..(1666): n is a, c, g, or t
gtgactctcgaggatcccctcgaattcgacggtttctcaaagctgcacaagaattttaaggattcatgaccccactttcattaaatagtcccagaagatagctaaataacattttcagatagaacctcacactgcataagtttcataacaaacaaacctaagatatgctgacagaaatcacattgagtttgcaagcactcaaatagaaaacccaagacctccggcaacaaattagaaaatatgaacagaaatattttaaaccacaagtatttcatcccaactaaattccaatttcttcaatgttctctgagttgttagatttcaaagtgaagagaactgaaatctctttttattcatagcagagccaaaactggaagtcacttattaaatacctgtgtacaaaacaccatacttggggctatatgcgatttcaggttggataaacgagtcatgttgaatgacaaaaagttagactggggagatttatggagagaagcaagcacctgtgatttgttggtttggcgttacaataaacactgtaagtgaaaatgagtcacaggcagttagaatggcgttaaggaaaccatttaggtctaaaaatcaggactgaagtgatcaacagttaacagatgaagccatgagaactggcacgctctggaaaggctggtgcagagagcaggacggtgagcctgagtgagcctggagttagtcaacagattcctcaacagaaaaggagtgaggagcagggtcaaagaaatgaaggtgaatttggggggtggtggtcaatgggttaaacgtacaagttgaggccgaggaactgaggctgaagaaggttctggcaagtggagaaccatgagatcctgacagagcaggcttttgtgggcagaagccatattagaagaagagctaaaggaaagctgaaaacctggcgacgaaaaggaagccaagaacataggagatattttgacaaaacggaaaaacaacagaacaggaagtgaggcaggagaaccacagagatggaagccaggaggtgtccaattagacgggcacaagagaaaaacagccagagaccgagaaaacggcgggaaggaaaggttccatctggagaaaaaagcctctcaagactggaagggacaggagctggtgaccatgaagcagttcagactcagctctgagccccttgtgtggaccacaagcagcactgcaaagtcctcgctgtagagagaagaccatagatgcacacagacggggttatcccttgaaaccagatccgggaagccatcagtcaaaaagcctgtgtggtcacagatgcttactggtggttcctgaaatgagtatttctaggcagggggcttcagtataaaccagatgtgtgctagctgggtggacttcaagtaaggagtcaagacaaaacacttagagtgaccttttggccactgctgtgtctgcaggctcagcctgctctagatctgattcccacagtggagggacaaagggccagcagcttgtaggaccaaatgagaaaaatacataatcattatgttttagccagaaaaaggcaacttgattatgaactggatgacatatcaaatgcaaggccttaaaatgcattcactctaataaactgctctgtagaattcaagggaatgaaatccgcttctcatangtaccaaggaccaactgctttgaatcttccactgtggatgatggcaactggtccttttaggagagccattttccagacagtcttgtctttatttatttattttttaattgttagtagcttttacttattatttatgtacttattttttgagacagtctcactctgtcacccaggctggagtgcagtggtgcaaccttgactcactacaacctcctcctcctgggttcaagtgattctcctgcctcagcctcatgagtagctgggattacaggcgtgcaccacctcgctcggctaattgtttttgttcttttttgagatggagtctcgttctatctcccaggctggagtgcagtggcacgatctcagctcaccacaatctccacctcccaggtttaagcaattctcctgcctcagcctcccaagtagctgggattacaggcatgcaccaccacacctggctaatttttgtatttttagtagaggcgaggtttcactatgttcgccaggatggtcttgaactcctgacctcaggtgttctgcccaccttggcctcccaaagtgttgggattacaggtgtgagccaccgtgcccggcctttttgtattttttagtagagatggggtttcaccatgttggccaggctggtcttgaactcctgacctaaagtgatccacccacctcagcctcccaaagtgctggaattacaggagtgagccaccatgccctgcccagtctttataaatgaagcttgactctggactgtgatagcagaaacaaatacaggcagtgcctcagagaatacaaaatatcaagcaaatcctaagtgttgaagctagaacccaggtgagtgcactctgcattactgagaatgtgctccctgccaaaaggctcctaccctattccaaccaagccggaaatggcaacagaccaaacgtgaggagtgagtgcctctgtgctccttgaggctgtttcattacagataacaaggttacctagggcagttgtgaagatgaaatgaggatgtgtgtggaagggcagagcagatgcttgatgttctccatctgaacactactcttgaccacagtatttctcattctcctttctgaaatgcctctaggccttaagcgcctatttctataaatgttgggtgatcagaccaatatggtttctgaaaaaactgttcagaaatagactaattttctttgggtggttcagtctgatgctgaaataaattgcaagatgattttcaaaaataacatgaaccccaacagcttcactgagaaatatggagcctcttcaaacgtgtttttaaaaagaactggatgtgcaggtgtaagagatttattacaaaacaaaaactccccttgccagccttattactctggctcatcattaaaatccagtgctagccatattacatgcccatcttaaaacttttatcctttagttacaaaaagaatactatgtagcttacatattcagaatttacctactaccccaccacatcaaagtccataaggtaccatatactcttccccgccccatgcttcatgggatgttattacagtatggtgctttacagcgaaaatgagagcagtcacttaagcggcttactgagacccaggcaatgttctaagcagctacacacagtaactcctaacaaccttaggaggcaggaaccaaaagctgaagcatcatacaacttgcctccaactaagaggggatctggggttcaaacccaggcagcctgacatgagcgtttcctttttttttttttctcttttgctaagtaaaaagtaggtttaagggaagaatcatttatagtaacactgaattaagtaagggtttgtaggtcacagaatcagactatttagggctgatacttcaagcatatctcaattaacaaaaaagcacattgagactccaaggatgaactgcctttgcttagtggccagggcactgtcaagacccagaggtctcctaattcccacgctagcacaccataccacccctttgttcaacctcacagaattgccaatactagcgtatcaccaggaatacttacgaaccatactaactcacatggaagaatggcaaatgaaaactggcccacattttcttgttccttcttcaaagagtaatagggttctacctaattgtgaactagaagctggggatgaaaaacaagccagatacagagctcacagtccagaaggagatgtcaacaagatgacaggctgccatgggtactgacagaagtctacataagggacagcaggggaacaaaaaaaggcacagtcaaaacatctttgactgcaatttggagactttaaacaaggattatcctttctacaggcatactgaattttctttttaatgcctcactgtgcctattaagcaaaatccgtaatacaacacaccagacagaagccttaccctgtgagccgggcgcagtggctcacgcctgtaagcctgacactttgtgaggccaaggtgggtgaatcacttgagctcaggagttcgagaccagcctggcaacatggtgaaaccccgtctctaccaaaaacaaaacaaaaacattagccaggcctgtggtgtgcgcctgtggtcccaaatacttggaaagctgaagcaggagaatcgcttgagcccaagaggcagaggctgccgtgagctgagatcatgccactgcattccagcctgggcaatacagtgagaccccatgtcaaaaaaaaaagaaaaagaaaaagaaaaaagataaaagcagctttaccctgtaatcttagttctagtactatctggttctgtaacccaagagcagatacttcactctcacctttaacgtgaagatttatctttcaatcctttagagcttgaaaatgcaatcaacccatgaaaatgtttttaaagaccatgattctgttcatcaaggagacatttaaaggtatgtcattaacagaaatttaaaagggtattgtgggtaactgaattatcatagatacaatacagcaagtatatatggtatattcattactgagatgatttgaactttccatattcaatatggaaccttgagcaagctacttaaattcaggttttgtctattccatctacaaaatgggaacagtatcaccttccttcagtgagctgtcgtaaaggtgtgtgatatgatgactagaaaacaaacagaacacagcacgtgattgatgtttaataaatgagttcccttccccctttcttaaactgcagcaaagtggtacccaaacctaagagctattatccctaaatttcaaaatctaaaaaaaaaaccttagaacctcagatgatataattaacataaaagcccaggtttttgtataaatgaaaagggataaaaattcatacaaaatccattagtaacattcataagcacccgaaataaattatttagatgtttgcaagtcagctgcaaggtgttcttcctcctcaaatatcctctaaggatgagcttatagacagattaacttaacaacgaaacctaacattccaccagtaagaatcttgtttgtgtgtgaagctgctttttactaagttggaggtaagagctcaaagtagagttttacttaagaaaattggggcaaacattgattttagttctacagctataaaatgatgccattcaaaaagtgaacagtgggccgggcacagtggctcctaccctattccaaccaagccggaaatggcaacagaccaaacgtgaggagtgagtgcctctgtgctccttgaggctgtttcattacagataacaaggttacctagggcagttgtgaagatgaaatgaggatgtgtgtggaagggcagagcagatgcttgatgttctccatctgaacactactcttgaccacagtatttctcattctcctttctgaaatgcctctaggccttaagcgcctatttctataaatgttgggtgatcagaccaatatggtttctgaaaaaactgttcagaaatagactaattttctttgggtggttcagtctgatgctgaaataaattgcaagatgattttcaaaaa

SEQ ID NO: 401997 - DNA, 4967 bp, Homo sapiens
  misc_feature (1898)..(1898): n is a, c, g, or t
tttgcttctattttggattcctcgtgcgtcttgagaccaagcaggaatatgcactggtactttagaaaacatttcatgttgcacacaaatactttcatgatcagctttaatttaagggacatgtaaataaaaagatgcatttgacaggacagcagactagttcaagcaggaggttagaccagtaacaacaaccaagaaagcaaagtgctcgtttccatcttggctttaccacacttacaaactgatacccaaataacagaaatgtttctcaaagctgcacaagaattttaaggattcatgaccccactttcattaaatagtcccagaagatagctaaataacattttcagatagaacctcacactgcataagtttcataacaaacaaacctaagatatgctgacagaaatcacattgagtttgcaagcactcaaatagaaaacccaagacctccggcaacaaattagaaaatatgaacagaaatattttaaaccacaagtatttcatcccaactaaattccaatttcttcaatgttctctgagttgttagatttcaaagtgaagagaactgaaatctctttttattcatagcagagccaaaactggaagtcacttattaaatacctgtgtacaaaacaccatacttggggctatatgcgatttcaggttggataaacgagtcatgttgaatgacaaaaagttagactggggagatttatggagagaagcaagcacctgtgatttgttggtttggcgttacaataaacactgtaagtgaaaatgagtcacaggcagttagaatggcgttaaggaaaccatttaggtctaaaaatcaggactgaagtgatcaacagttaacagatgaagccatgagaactggcacgctctggaaaggctggtgcagagagcaggacggtgagcctgagtgagcctggagttagtcaacagattcctcaacagaaaaggagtgaggagcagggtcaaagaaatgaaggtgaatttggggggtggtggtcaatgggttaaacgtacaagttgaggccgaggaactgaggctgaagaaggttctggcaagtggagaaccatgagatcctgacagagcaggcttttgtgggcagaagccatattagaagaagagctaaaggaaagctgaaaacctggcgacgaaaaggaagccaagaacataggagatattttgacaaaacggaaaaacaacagaacaggaagtgaggcaggagaaccacagagatggaagccaggaggtgtccaattagacgggcacaagagaaaaacagccagagaccgagaaaacggcgggaaggaaaggttccatctggagaaaaaagcctctcaagactggaagggacaggagctggtgaccatgaagcagttcagactcagctctgagccccttgtgtggaccacaagcagcactgcaaagtcctcgctgtagagagaagaccatagatgcacacagacggggttatcccttgaaaccagatccgggaagccatcagtcaaaaagcctgtgtggtcacagatgcttactggtggttcctgaaatgagtatttctaggcagggggcttcagtataaaccagatgtgtgctagctgggtggacttcaagtaaggagtcaagacaaaacacttagagtgaccttttggccactgctgtgtctgcaggctcagcctgctctagatctgattcccacagtggagggacaaagggccagcagcttgtaggaccaaatgagaaaaatacataatcattatgttttagccagaaaaaggcaacttgattatgaactggatgacatatcaaatgcaaggccttaaaatgcattcactctaataaactgctctgtagaattcaagggaatgaaatccgcttctcatangtaccaaggaccaactgctttgaatcttccactgtggatgatggcaactggtccttttaggagagccattttccagacagtcttgtctttatttatttattttttaattgttagtagcttttacttattatttatgtacttattttttgagacagtctcactctgtcacccaggctggagtgcagtggtgcaaccttgactcactacaacctcctcctcctgggttcaagtgattctcctgcctcagcctcatgagtagctgggattacaggcgtgcaccacctcgctcggctaattgtttttgttcttttttgagatggagtctcgttctatctcccaggctggagtgcagtggcacgatctcagctcaccacaatctccacctcccaggtttaagcaattctcctgcctcagcctcccaagtagctgggattacaggcatgcaccaccacacctggctaatttttgtatttttagtagaggcgaggtttcactatgttcgccaggatggtcttgaactcctgacctcaggtgttctgcccaccttggcctcccaaagtgttgggattacaggtgtgagccaccgtgcccggcctttttgtattttttagtagagatggggtttcaccatgttggccaggctggtcttgaactcctgacctaaagtgatccacccacctcagcctcccaaagtgctggaattacaggagtgagccaccatgccctgcccagtctttataaatgaagcttgactctggactgtgatagcagaaacaaatacaggcagtgcctcagagaatacaaaatatcaagcaaatcctaagtgttgaagctagaacccaggtgagtgcactctgcattactgagaatgtgctccctgccaaaaggctcctaccctattccaaccaagccggaaatggcaacagaccaaacgtgaggagtgagtgcctctgtgctccttgaggctgtttcattacagataacaaggttacctagggcagttgtgaagatgaaatgaggatgtgtgtggaagggcagagcagatgcttgatgttctccatctgaacactactcttgaccacagtatttctcattctcctttctgaaatgcctctaggccttaagcgcctatttctataaatgttgggtgatcagaccaatatggtttctgaaaaaactgttcagaaatagactaattttctttgggtggttcagtctgatgctgaaataaattgcaagatgattttcaaaaataacatgaaccccaacagcttcactgagaaatatggagcctcttcaaacgtgtttttaaaaagaactggatgtgcaggtgtaagagatttattacaaaacaaaaactccccttgccagccttattactctggctcatcattaaaatccagtgctagccatattacatgcccatcttaaaacttttatcctttagttacaaaaagaatactatgtagcttacatattcagaatttacctactaccccaccacatcaaagtccataaggtaccatatactcttccccgccccatgcttcatgggatgttattacagtatggtgctttacagcgaaaatgagagcagtcacttaagcggcttactgagacccaggcaatgttctaagcagctacacacagtaactcctaacaaccttaggaggcaggaaccaaaagctgaagcatcatacaacttgcctccaactaagaggggatctggggttcaaacccaggcagcctgacatgagcgtttcctttttttttttttctcttttgctaagtaaaaagtaggtttaagggaagaatcatttatagtaacactgaattaagtaagggtttgtaggtcacagaatcagactatttagggctgatacttcaagcatatctcaattaacaaaaaagcacattgagactccaaggatgaactgcctttgcttagtggccagggcactgtcaagacccagaggtctcctaattcccacgctagcacaccataccacccctttgttcaacctcacagaattgccaatactagcgtatcaccaggaatacttacgaaccatactaactcacatggaagaatggcaaatgaaaactggcccacattttcttgttccttcttcaaagagtaatagggttctacctaattgtgaactagaagctggggatgaaaaacaagccagatacagagctcacagtccagaaggagatgtcaacaagatgacaggctgccatgggtactgacagaagtctacataagggacagcaggggaacaaaaaaaggcacagtcaaaacatctttgactgcaatttggagactttaaacaaggattatcctttctacaggcatactgaattttctttttaatgcctcactgtgcctattaagcaaaatccgtaatacaacacaccagacagaagccttaccctgtgagccgggcgcagtggctcacgcctgtaagcctgacactttgtgaggccaaggtgggtgaatcacttgagctcaggagttcgagaccagcctggcaacatggtgaaaccccgtctctaccaaaaacaaaacaaaaacattagccaggcctgtggtgtgcgcctgtggtcccaaatacttggaaagctgaagcaggagaatcgcttgagcccaagaggcagaggctgccgtgagctgagatcatgccactgcattccagcctgggcaatacagtgagaccccatgtcaaaaaaaaaagaaaaagaaaaagaaaaaagataaaagcagctttaccctgtaatcttagttctagtactatctggttctgtaacccaagagcagatacttcactctcacctttaacgtgaagatttatctttcaatcctttagagcttgaaaatgcaatcaacccatgaaaatgtttttaaagaccatgattctgttcatcaaggagacatttaaaggtataattaaactttacttcctctctttcttcttcccactcatcctaaccctactcctaatcacataacctattcccccgagcaatctcaattacaatatatacaccaacaaccaagcaacccct

SEQ ID NO: 401998 - DNA, 3511 bp, Homo sapiens
  misc_feature (1898)..(1898): n is a, c, g, or t
tttgcttctattttggattcctcgtgcgtcttgagaccaagcaggaatatgcactggtactttagaaaacatttcatgttgcacacaaatactttcatgatcagctttaatttaagggacatgtaaataaaaagatgcatttgacaggacagcagactagttcaagcaggaggttagaccagtaacaacaaccaagaaagcaaagtgctcgtttccatcttggctttaccacacttacaaactgatacccaaataacagaaatgtttctcaaagctgcacaagaattttaaggattcatgaccccactttcattaaatagtcccagaagatagctaaataacattttcagatagaacctcacactgcataagtttcataacaaacaaacctaagatatgctgacagaaatcacattgagtttgcaagcactcaaatagaaaacccaagacctccggcaacaaattagaaaatatgaacagaaatattttaaaccacaagtatttcatcccaactaaattccaatttcttcaatgttctctgagttgttagatttcaaagtgaagagaactgaaatctctttttattcatagcagagccaaaactggaagtcacttattaaatacctgtgtacaaaacaccatacttggggctatatgcgatttcaggttggataaacgagtcatgttgaatgacaaaaagttagactggggagatttatggagagaagcaagcacctgtgatttgttggtttggcgttacaataaacactgtaagtgaaaatgagtcacaggcagttagaatggcgttaaggaaaccatttaggtctaaaaatcaggactgaagtgatcaacagttaacagatgaagccatgagaactggcacgctctggaaaggctggtgcagagagcaggacggtgagcctgagtgagcctggagttagtcaacagattcctcaacagaaaaggagtgaggagcagggtcaaagaaatgaaggtgaatttggggggtggtggtcaatgggttaaacgtacaagttgaggccgaggaactgaggctgaagaaggttctggcaagtggagaaccatgagatcctgacagagcaggcttttgtgggcagaagccatattagaagaagagctaaaggaaagctgaaaacctggcgacgaaaaggaagccaagaacataggagatattttgacaaaacggaaaaacaacagaacaggaagtgaggcaggagaaccacagagatggaagccaggaggtgtccaattagacgggcacaagagaaaaacagccagagaccgagaaaacggcgggaaggaaaggttccatctggagaaaaaagcctctcaagactggaagggacaggagctggtgaccatgaagcagttcagactcagctctgagccccttgtgtggaccacaagcagcactgcaaagtcctcgctgtagagagaagaccatagatgcacacagacggggttatcccttgaaaccagatccgggaagccatcagtcaaaaagcctgtgtggtcacagatgcttactggtggttcctgaaatgagtatttctaggcagggggcttcagtataaaccagatgtgtgctagctgggtggacttcaagtaaggagtcaagacaaaacacttagagtgaccttttggccactgctgtgtctgcaggctcagcctgctctagatctgattcccacagtggagggacaaagggccagcagcttgtaggaccaaatgagaaaaatacataatcattatgttttagccagaaaaaggcaacttgattatgaactggatgacatatcaaatgcaaggccttaaaatgcattcactctaataaactgctctgtagaattcaagggaatgaaatccgcttctcatangtaccaaggaccaactgctttgaatcttccactgtggatgatggcaactggtccttttaggagagccattttccagacagtcttgtctttatttatttattttttaattgttagtagcttttacttattatttatgtacttattttttgagacagtctcactctgtcacccaggctggagtgcagtggtgcaaccttgactcactacaacctcctcctcctgggttcaagtgattctcctgcctcagcctcatgagtagctgggattacaggcgtgcaccacctcgctcggctaattgtttttgttcttttttgagatggagtctcgttctatctcccaggctggagtgcaagtgagaccccatgtcaaaaaaaaaagaaaaagaaaaagaaaaaagataaaagcagctttaccctgtaatcttagttctagtactatctggttctgtaacccaagagcagatacttcactctcacctttaacgtgaagatttatctttcaatcctttagagcttgaaaatgcaatcaacccatgaaaatgtttttaaagaccatgattctgttcatcaaggagacatttaaaggtatgtcattaacagaaatttaaaagggtattgtgggtaactgaattatcatagatacaatacagcaagtatatatggtatattcattactgagatgatttgaactttccatattcaatatggaaccttgagcaagctacttaaattcaggttttgtctattccatctacaaaatgggaacagtatcaccttccttcagtgagctgtcgtaaaggtgtgtgatatgatgactagaaaacaaacagaacacagcacgtgattgatgtttaataaatgagttcccttccccctttcttaaactgcagcaaagtggtacccaaacctaagagctattatccctaaatttcaaaatctaaaaaaaaaaccttagaacctcagatgatataattaacataaaagcccaggtttttgtataaatgaaaagggataaaaattcatacaaaatccattagtaacattcataagcacccgaaataaattatttagatgtttgcaagtcagctgcaaggtgttcttcctcctcaaatatcctctaaggatgagcttatagacagattaacttaacaacgaaacctaacattccaccagtaagaatcttgtttgtgtgtgaagctgctttttactaagttggaggtaagagctcaaagtagagttttacttaagaaaattggggcaaacattgattttagttctacagctataaaatgatgccattcaaaaagtgaacagtgggccgggcacagtggctcacgcctgtaatcccagcacactttgggaggccaaggcaggcgtatcacctgtggtcaggagttcaagaccagcctggccaaatgacgaaaccccgtctctactaaaaatgcaaaaattaggcaggtgcggtgacgggcgcctgtaatccaagctactcaggaggctgagacagggagaactgcttgaacccaagaggcagaagttgcagtgagccgagatcgcaccactgcactccagcctgggtgacacagagactccgtctcagggggcaaaaaaaaa

SEQ ID NO: 401999 - DNA, 4528 bp, Homo sapiens
  misc_feature (473)..(473): n is a, c, g, or t
cggatcatttctctactcagaaacctgaaacatcggcattatcctcctgcttgcaactatagcaacagcctgcatatccgggaagccatcagtcaaaaagcctgtgtggtcacagatgcttactggtggttcctgaaatgagtatttctaggcagggggcttcagtataaaccagatgtgtgctagctgggtggacttcaagtaaggagtcaagacaaaacacttagagtgaccttttggccactgctgtgtctgcaggctcagcctgctctagatctgattcccacagtggagggacaaagggccagcagcttgtaggaccaaatgagaaaaatacataatcattatgttttagccagaaaaaggcaacttgattatgaactggatgacatatcaaatgcaaggccttaaaatgcattcactctaataaactgctctgtagaattcaagggaatgaaatccgcttctcatangtaccaaggaccaactgctttgaatcttccactgtggatgatggcaactggtccttttaggagagccattttccagacagtcttgtctttatttatttattttttaattgttagtagcttttacttattatttatgtacttattttttgagacagtctcactctgtcacccaggctggagtgcagtggtgcaaccttgactcactacaacctcctcctcctgggttcaagtgattctcctgcctcagcctcatgagtagctgggattacaggcgtgcaccacctcgctcggctaattgtttttgttcttttttgagatggagtctcgttctatctcccaggctggagtgcagtggcacgatctcagctcaccacaatctccacctcccaggtttaagcaattctcctgcctcagcctcccaagtagctgggattacaggcatgcaccaccacacctggctaatttttgtatttttagtagaggcgaggtttcactatgttcgccaggatggtcttgaactcctgacctcaggtgttctgcccaccttggcctcccaaagtgttgggattacaggtgtgagccaccgtgcccggcctttttgtattttttagtagagatggggtttcaccatgttggccaggctggtcttgaactcctgacctaaagtgatccacccacctcagcctcccaaagtgctggaattacaggagtgagccaccatgccctgcccagtctttataaatgaagcttgactctggactgtgatagcagaaacaaatacaggcagtgcctcagagaatacaaaatatcaagcaaatcctaagtgttgaagctagaacccaggtgagtgcactctgcattactgagaatgtgctccctgccaaaaggctcctaccctattccaaccaagccggaaatggcaacagaccaaacgtgaggagtgagtgcctctgtgctccttgaggctgtttcattacagataacaaggttacctagggcagttgtgaagatgaaatgaggatgtgtgtggaagggcagagcagatgcttgatgttctccatctgaacactactcttgaccacagtatttctcattctcctttctgaaatgcctctaggccttaagcgcctatttctataaatgttgggtgatcagaccaatatggtttctgaaaaaactgttcagaaatagactaattttctttgggtggttcagtctgatgctgaaataaattgcaagatgattttcaaaaataacatgaaccccaacagcttcactgagaaatatggagcctcttcaaacgtgtttttaaaaagaactggatgtgcaggtgtaagagatttattacaaaacaaaaactccccttgccagccttattactctggctcatcattaaaatccagtgctagccatattacatgcccatcttaaaacttttatcctttagttacaaaaagaatactatgtagcttacatattcagaatttacctactaccccaccacatcaaagtccataaggtaccatatactcttccccgccccatgcttcatgggatgttattacagtatggtgctttacagcgaaaatgagagcagtcacttaagcggcttactgagacccaggcaatgttctaagcagctacacacagtaactcctaacaaccttaggaggcaggaaccaaaagctgaagcatcatacaacttgcctccaactaagaggggatctggggttcaaacccaggcagcctgacatgagcgtttcctttttttttttttctcttttgctaagtaaaaagtaggtttaagggaagaatcatttatagtaacactgaattaagtaagggtttgtaggtcacagaatcagactatttagggctgatacttcaagcatatctcaattaacaaaaaagcacattgagactccaaggatgaactgcctttgcttagtggccagggcactgtcaagacccagaggtctcctaattcccacgctagcacaccataccacccctttgttcaacctcacagaattgccaatactagcgtatcaccaggaatacttacgaaccatactaactcacatggaagaatggcaaatgaaaactggcccacattttcttgttccttcttcaaagagtaatagggttctacctaattgtgaactagaagctggggatgaaaaacaagccagatacagagctcacagtccagaaggagatgtcaacaagatgacaggctgccatgggtactgacagaagtctacataagggacagcaggggaacaaaaaaaggcacagtcaaaacatctttgactgcaatttggagactttaaacaaggattatcctttctacaggcatactgaattttctttttaatgcctcactgtgcctattaagcaaaatccgtaatacaacacaccagacagaagccttaccctgtgagccgggcgcagtggctcacgcctgtaagcctgacactttgtgaggccaaggtgggtgaatcacttgagctcaggagttcgagaccagcctggcaacatggtgaaaccccgtctctaccaaaaacaaaacaaaaacattagccaggcctgtggtgtgcgcctgtggtcccaaatacttggaaagctgaagcaggagaatcgcttgagcccaagaggcagaggctgccgtgagctgagatcatgccactgcattccagcctgggcaatacagtgagaccccatgtcaaaaaaaaaagaaaaagaaaaagaaaaaagataaaagcagctttaccctgtaatcttagttctagtactatctggttctgtaacccaagagcagatacttcactctcacctttaacgtgaagatttatctttcaatcctttagagcttgaaaatgcaatcaacccatgaaaatgtttttaaagaccatgattctgttcatcaaggagacatttaaaggtatgtcattaacagaaatttaaaagggtattgtgggtaactgaattatcatagatacaatacagcaagtatatatggtatattcattactgagatgatttgaactttccatattcaatatggaaccttgagcaagctacttaaattcaggttttgtctattccatctacaaaatgggaacagtatcaccttccttcagtgagctgtcgtaaaggtgtgtgatatgatgactagaaaacaaacagaacacagcacgtgattgatgtttaataaatgagttcccttccccctttcttaaactgcagcaaagtggtacccaaacctaagagctattatccctaaatttcaaaatctaaaaaaaaaaccttagaacctcagatgatataattaacataaaagcccaggtttttgtataaatgaaaagggataaaaattcatacaaaatccattagtaacattcataagcacccgaaataaattatttagatgtttgcaagtcagctgcaaggtgttcttcctcctcaaatatcctctaaggatgagcttatagacagattaacttaacaacgaaacctaacattccaccagtaagaatcttgtttgtgtgtgaagctgctttttactaagttggaggtaagagctcaaagtagagttttacttaagaaaattggggcaaacattgattttagttctacagctataaaatgatgccattcaaaaagtgaacagtgggccgggcacagtggctcctaccctattccaaccaagccggaaatggcaacagaccaaacgtgaggagtgagtgcctctgtgctccttgaggctgtttcattacagataacaaggttacctagggcagttgtgaagatgaaatgaggatgtgtgtggaagggcagagcagatgcttgatgttctccatctgaacactactcttgaccacagtatttctcattctcctttctgaaatgcctctaggccttaagcgcctatttctataaatgttgggtgatcagaccaatatggtttctgaaaaaactgttcagaaatagactaattttctttgggtggttcagtctgatgctgaaataaattgcaagatgattttcaaaaa

SEQ ID NO: 402000 - DNA, 441 bp, Homo sapiens
agtttatccaaaaagtccagcatggtttacttgagaaggaaatatgttcagaatctctaagcactgcagaaggcacctgcagtgcagaagagttggcagtgaggtctttctcctggggtctgggcggaacatgtgagcagtcgggaaggcacacacagtgggagccagtaagggcccctgtgcatctgcaggagctgaggacagaaggggtgggcctccacggtgggcatgtaggagtgggcacagagaagggccacagatctgagacagagacagacaggacttcttaccctgctgagccctgcagggagccacttcgtctttcagccctgattttgtcatctgtaaggaaatttcctctctcccagggtaatcatgtgaagccaatgaaataataaaaaggaccacatcggatgacccctgaggcaggtctgctcccca

SEQ ID NO: 402001 - DNA, 244 bp, Homo sapiens
tgcagactataaaataacaggggttagccagatttgtaaatccctgttctagagaactttttccttatgttaaagagttacagttaactagtaggggcagggggagattttttaaactgtcagcactttcacttatatgtaagtactaaagtaaatcatcacaaaataaatataaggaagacataactattaattcagatattataaattaagaggctgacagaattcagtttttaagagaaca

SEQ ID NO: 402002 - DNA, 580 bp, Homo sapiens
agcattttatttgagaaaacatttggtttgtttttagttatttttctttcaaagcaattgtaaaagtaggctcttgactttgaagtagtatttgcctttcttttcttgttttcttttttctttttcttttgaaaaaaatctctaaagtctcctggaatcactgcaggatattatgactcagcttgaccttcctccctgtcaccctcagtggccctcacaagctatcctcactcccagaatgggaggctctgggttccctcctaatgcatttgaaggccacaggggtgggggtggcaggtgctgcaacagacatgtacacacacacacacacacacacacgcacactcccctcccccagctacaggcaatccctgagcaacctagggagcaaccctagagctccaaggaacacaagagtttgaggccacttctttagcctttgaactggttattcatcctcattcttacctggcattatttggaatgcttcatttcctctgtacctggccttcactcttgggaagtctagcttgtttgtgcagtttcctactgtttaaacaagagattgtttaaactctag

SEQ ID NO: 402003 - DNA, 328 bp, Homo sapiens
gaaacctcccaggcagggaatcacctcttcacacacagtttgcatctctgcagttgacggcaggagcaaaaaatgtggccagccaggttggaagggtgacaactgatggaggcatggaaccaccttcggcttggggccaacccaggttactaatcacaggtcaggtattcaggtcagatgtccaccattcacacgggctctttgtctgccaaggcctgggtccaggctatgagtgttcaaaaatagaacaggaagttcagaaaaaagcagaagccaagagaaggttacagcatgggagggcaggcttgggagagaggatttatcttgt

SEQ ID NO: 402004 - DNA, 201 bp, Homo sapiens
gtttcatcgataaataatagttttttaggttactatcatttaacaagcatatattacacctgtcactggtctaacatgaattatcccaattctctcaaaagccctatgaaataaattctattattgcttccattttataagatatatgaatattggaggacaaatttaaaaagacttgtccaacatgattctgtctttgca

SEQ ID NO: 402005 - DNA, 345 bp, Homo sapiens
ccacatttgcaggaaaacagggtgaatctcatctaaatacactgtccatcataacagacttagaatgaaagggaaagtaaagaacagtaacaactgaccaactctgagacaaagagagaagatttggaagatggacagatgataattgaagtggggagaaatgaagaaaaaaagtactgaaaaatcacagcaaacaacaacaacaaaagggcaaaaatcagtctcaataaagagacttaggtctcaatgaagagagatagttgcctcaggaactgctatagtacttgccttttttaagaaaatggagatagtgaattcattcattcaacacatcagcgcaaacta

SEQ ID NO: 402006 - DNA, 478 bp, Homo sapiens
gaaaatgtgggttaaaactgtgactcggtgcattcactgtttatctgttgatggcattgtcgttagtccctgctgccaaccccagcccgaagaggcttctctgtggtgtgggaagcaggtgtcgctcccctgattctgccatcagcccacatcaggcatcctaagcgagatggaggctaggcctccactggcaggcgaacccatgaagctcaggagcatgaattggttttcggatgagcctgtgagattcctagcaaggcctggaagggttgggacccaggacaggggagttttgatgatgatgagactgatcagtgcccccagctgttgatactagggagcgcccatgggtgccacagttcactgagagagcaaggaagagcctaagatggccagagtgcatgcatgcacacacacaccacacacacgttcacggtcacactcatgcacatgcatgctcacacatgatcacatacac

SEQ ID NO: 402007 - DNA, 528 bp, Homo sapiens
ttggtcagtctctacaggatcccccctggctaatcacagaaagactctgtactcagctctgtactactgctgtgtactcagcaatagtatagcctcagagccttccttggagtatctgtcagtaacactgacccaacagtcctgtcaaattgtgaccacccttccaatcaagtcatactttcagatcccacactagttctggaacttaagtgcatttcttagttggtaacaatatactgtaagtttacactttatttaagctccagtgctgatttaaaaatcagtatgttaggccaggcacggtggctcatgcctggaatcccaacactttaggagcccaagatgggcagatcacgaggtcagatcgagaccaccctggttaacacggtgaaatcccctctctactaaaaaaaatacaaaaaatacaaaaaaattagccggccatggtggcaggcagctgcagtcccagctactcaggagactgaggcaggagaatggcgtgaatctgggaggcagagcttgcagtga

SEQ ID NO: 402008 - DNA, 541 bp, Homo sapiens
agcctcctcatcttcaaagagcatcaagcactaaaacggtaagagtggccaggtctggagtgcagcggagactcgaggagagataaaaggctgccaagagcacacccagcctctctggggacgtggggtacgtgctatgaatgcaccttgcagtttctcacccacatgaggggggagttgatctctgcggtccccttcagcttaaaaacctcatgctgatcccaggcttccggacttcatctgtcaataacgatgaatgcagggaactgcagcctgtctaccagtagcccttgcaccacagaaaaaggaaggtaaatccacaactggaagaaagcatcatgggctgcaggccacagccatgcctccgtgggcctggcactgtacacttcttggaaagatctaggcctctcggcccccatcatgccgaaattagaggctggctccgtgtggctgcattgcacctgccagcagggttacacctgtatgatcagaaatgtgtaagagcagattttactggactaataaaaattaaaatgacaaa

SEQ ID NO: 402009 - DNA, 363 bp, Homo sapiens
ccatgggagtaggaacatcaggtccaagcctctaagaccaggaaatccatgagcattaaaggaatgagatcagaattggcaggcaaggaggctgagtcatgggggctcacggtctcaacaaggaaatgggtcactggcggggtcagtacaggaccctacgtgaaagaaaggagtttgccacagaccaaccccttttgcctctgcttagaattttttaaaattaatagactttattttttagaccgtttttaggttaacagaatggaacagatagtgcagagagttcccagataccaccttctcccccaatcccctacacaccagtttcccctattttcctatttttaatattgtacatttgaa

SEQ ID NO: 402010 - DNA, 330 bp, Homo sapiens
ctggatgcttcctgccctcgaaaatcagactccaagttcttcaactctgggactcggacctttgaacacagactgaaggctgcactgtcggcttccttacttttgaggctttgggacttggactgacttcctggatcctcagcttgcagatggcctattgtgggacctcaccttgtgatcacgtgagtcagtgctccttaacaaactcccctttgtatatacatctatcctactacttctgtcactctagagaaccttgacgaatacggttatgcatttttattaatgtaaattatgccttaattaacaataaataccttctcaacctcc

SEQ ID NO: 402011 - DNA, 245 bp, Homo sapiens
tatatagatagacagatatgacagactgtcactttgaaaaccattaagaacgaatgcagaaacacaagggactggaggaactggtttcaagaagcaggaactggaggaactggtttcaagaagcaggaactggccagttcctgcttctctggaaatatttgtttctgggcattacgtgtccatgtgatggatgcagtaatgactctgccaggtagagcctgcagctggtctcaggtcaggattct

SEQ ID NO: 402012 - DNA, 440 bp, Homo sapiens
ttaaagaaagaaaatactatggtctgaatgttttccccaaaattcttaaattaagatcctaaatcccaaggtgatggcattaggagaaggggccttttgggaggtgattaagtcatgagagtggagacctcatgaatgggattaatgcccttataaaagaggtccaagggaacttgtttgccccttgtaccatatgaaggtggagaaggtgtagctgtgagctgatggcagtactcacagcacctggagcccagagacagaattcatttcaggctccccagcttctggtggggccatggattctgggtgtccttggcctgaggctgcctcgccccagtctgtgcctccatgtcacatggccatcttcctcctgcctctgcatctcttcttataaggatgttgtcatgttggagttacagcccaccctactttgctatgac

SEQ ID NO: 402013 - DNA, 2707 bp, Homo sapiens
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacagaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtca

SEQ ID NO: 402014 - DNA, 456 bp, Homo sapiens
  misc_feature (22)..(22): n is a, c, g, or t
  misc_feature (24)..(24): n is a, c, g, or t
  misc_feature (26)..(26): n is a, c, g, or t
ccttggctgcaggaattcggcncnangtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtca

SEQ ID NO: 402015 - DNA, 1185 bp, Homo sapiens
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattaggtattcagtcacctttgtttcataatatatttcctttgagtaacttcttattctttatgaaacttacagttaaatctttagttctggttaaaatctttaaaaaatatttttcagctgaattcagttctgattcagttatgattaaaacaatttcaacttaaactataaaatgtttctttttttgaggttttatattacttgctagactgcagagcccgtttctttcatcataacatcgtttagatgtttcctgtttaaaatcagtgttacaagttattaaggtattgtacagcaaagctagttaaagagaatgtagactctgtgagtggc

SEQ ID NO: 402016 - DNA, 2227 bp, Homo sapiens
aagaaaagaagcgattggatacatatgaaccccggtggttaaaaaagcaggtgtacgtcgggaatcggatatgtcgacagcgtcgatcgcagatcggatcgcgcgagagcgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacagaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtca

SEQ ID NO: 402017 - DNA, 3040 bp, Homo sapiens
  misc_feature (2757)..(2757): n is a, c, g, or t
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacagaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcaaaaaaaaaaaagaaaaaggcaggtttctgtttggttggcgccctaacggncagaactaaagcaccttggcaggaatgaagttgggtctgcaagtcgggctgaatggttggggcgaattgggcataggcgctctggctgcaaatgggccgtaaaggactcactaatggtgccacttcgggacgggcggcaggcctcgaggttggacggcctttccaataattggggctcgaactgcaaccgcggagcttatcgatctgtgttttcacacttgatttggccaagcgccaaagaccctggccgcttcacggaggcggtttcacacgcgtgtacact

SEQ ID NO: 402018 - DNA, 2646 bp, Homo sapiens
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagttgctcttttctcactaataggaacttgtaattccagcagtaatttaaaggctttcagagagaccctgagtcttctcttcaggttcacagaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtca

SEQ ID NO: 402019 - DNA, 2292 bp, Homo sapiens
  misc_feature (2292)..(2292): n is a, c, g, or t
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacagaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaacagttcaaaagcgtgctcttcagattctatgcaagtacaccccttgtgacggaacacgatctcccatcgagtgacattatttcgcggtaagggatcaatacctagcatgtggacaacggtgtatgctacagctaatgagggtagcattagtgctgttaatgatcaacagcaatatgtgcgtattatgcgtgcgtttcgn

SEQ ID NO: 402020 - DNA, 1020 bp, Homo sapiens
  misc_feature (2)..(3): n is a, c, g, or t
  misc_feature (5)..(5): n is a, c, g, or t
  misc_feature (7)..(7): n is a, c, g, or t
tnntntntgcttttaactgacaatttcatcccgaacgtctcctgggaggcatagaccatgtacaggaatccatcttcatctttctcactctcatacacctctgagattggtgtggagacgctgaccatgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtca

SEQ ID NO: 402021 - DNA, 1648 bp, Homo sapiens
  misc_feature (1365)..(1365): n is a, c, g, or t
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaaaaaaaaaaaaagaaaaaggcaggtttctgtttggttggcgccctaacggncagaactaaagcaccttggcaggaatgaagttgggtctgcaagtcgggctgaatggttggggcgaattgggcataggcgctctggctgcaaatgggccgtaaaggactcactaatggtgccacttcgggacgggcggcaggcctcgaggttggacggcctttccaataattggggctcgaactgcaaccgcggagcttatcgatctgtgttttcacacttgatttggccaagcgccaaagaccctggccgcttcacggaggcggtttcacacgcgtgtacact

SEQ ID NO: 402022 - DNA, 1056 bp, Homo sapiens
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaatgtcgacgcggccgcgaatttagtagtagtagtcgacc

SEQ ID NO: 402023 - DNA, 1112 bp, Homo sapiens
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtaggtagtctcaggcctcggtttcagtcatgaatgtacgcagaggagagcaccgcataagtgcatccacttgacgggtttttacaggaatcaccagacagccaaaccctgggtgtcagtttcacaacctagagagaggtatcctttttttaagagacagggtctcactctctttcccaggctggagtgcagtggtgcgatcgtagctcagtgcagtctcagccaccttgtgctcaagcagtcctccctcctcagcctcctgagtagctctgactagaggcacacaccactacacctggctaattttttaagttttttgtagagacagggtcttgctatgtttaacaacccaggctgatctcaa

SEQ ID NO: 402024 - DNA, 1315 bp, Homo sapiens
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaa

SEQ ID NO: 402025 - DNA, 1186 bp, Homo sapiens
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaaggacaacacaacggggggtggttcaaccaactggagaattcggatcaaggttcaattccaaatccacaggattcatggaaacccaggtaagtggtttcccaaacctta

SEQ ID NO: 402026 - DNA, 612 bp, Homo sapiens
tccgcggcggggtgcctgccgtaccccggccaccgccgcccccgcaagcgcgctgcgggcgagggtcgcgcttctggggcccaacagcccccggggccgcgctgggccgttcggctctgaagcggggctgcgccgggacccagcgcgtcaccttcagggctggttttcccgtcgagggagcccgcccgggtgcgagtgcctcttacagacctcagtgcctcggtcgagaggaggggaatgtgctgggccccggcctcgccgcgcccgggacggcccacagcggtgttgccagttcctgtctgtagcccaggagctggggtgggagacttctcttgggtttgcgattacgttctcaccttggcaccaggaataccgaatacatcccttttctgccggttcagactggaaacccagcttaggtgtgctggcatttggttaaacgtgcaggtgtcaccatcacaatatttactccacgcagatgatgcgaagtgattatttcccgcttgagcaagagaacgccgcagatccagaacaaagagtagaagatgtccgacttattcgagagcagcatccaaccaaaatcccgggtggaagaattactgtatatagaaa

SEQ ID NO: 402027 - DNA, 3364 bp, Homo sapiens
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacagaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcaaaaaaaaaagggcggccgccccttttttcttgcttgtataatgatcatttatgttctttttcacacttttgcaacaagggctaaaaaggggggggtcataacgggggaataaaccccgctgtcatactgcagcacaattattcggtgttatgaagaacattagacccaactaacagcgggcgacgtcaccccaacgggtattatttgtcacacaaaaaacacttcttttgggaacaaacttttgcaccacaaccagtaattgaggacatcaaaacgcacggggcccccagagtggaaacccccgggcgcaaaaatatgttgcgccacaagcagtttccaaggaacggacaccaagtagttatataacaccagggggaaaaatccccactcgcaccacaaggcgcaacacgcaactatacaaccaggtcaccgagtcgatcaagggggcgaacatttatcacccacccagtcagacaaaccacatatatacaccacacaggatacgtgtgatagaccccttactagacgacaataagattgacccacccgcaacagtaggtcgacccatcaaagacaagaacccccaaaccgtcgaagacacttgccagaaaatgccggcccaatgtctaaccacaaaccagatgtacgagaaatgac

SEQ ID NO: 402028 - DNA, 2346 bp, Homo sapiens
  misc_feature (2346)..(2346): n is a, c, g, or t
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcatctcttctagaattgtttaaacccttaccaaggaaaaaaaaggggtgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagttttaaaaacaagctagcctacattaaataatataggctagcttgtttttaaactttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacagaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaacagttcaaaagcgtgctcttcagattctatgcaagtacaccccttgtgacggaacacgatctcccatcgagtgacattatttcgcggtaagggatcaatacctagcatgtggacaacggtgtatgctacagctaatgagggtagcattagtgctgttaatgatcaacagcaatatgtgcgtattatgcgtgcgtttcgn

SEQ ID NO: 402029 - DNA, 1226 bp, Homo sapiens
gcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccccgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaattgaacgttcttctcaaataacagacaaaaatccaataagctctccatcttactcatgacattcactctttctgtctccctccctgtatctgtctgtccctcatttctaactctgcccgtctgtctacatctctgattaccctgctttctaactctgcctaggtgactgtccctctctgtttttgacttctctgtctctgactgaccctcctctctctctgcctattgcatgtgtctctatgactcgtgtgtgtgttagaattga

SEQ ID NO: 402030 - DNA, 1055 bp, Homo sapiens
gcattcccaaaggccccacctgttcattctaccccattggtagaattcccattgggaattaggcttcaacatacaaatttgggagacactgacatttaggccatagcgcgtcaaaggcaaagtgaggctgagtgtggaaaccatcccagaatctggatgtggcccaggcagaaggaaactcaaagtgatggggtgaccgatggtccctggtctgtgcaggactcagcggtgcggatggccctgggcacggtggcagtggctgttggaggatgatagggaacatgttggtggggggagggtggagcccactatgagtggcaactccctgggggcacaggaaacaaagctagaggtggctcccctctcccctccctgcacacagtgtcacctctgtggtggccctgtcgtccgcctcagttcacaggtgttgctgtaacaactcctgaaattaccttcaaaaaggaggctcgtgcaggtgcctgcaggagccaggaggccgaagtgcatcctgagtgtccggggacaggcagcctggcggggtccacggccccacagtcccaacgactgcctcagaaatgggcagagagcatgcctggttctagctggcaaggcccacatctcagagctgtggacagtcatgaagggtccgtgagcatggagagggggcaaaaatgacccatgaacctcaggccactgtgctgccatccagccaagtggggtaccagcccttcgggcctcgagatcctctacccttctctgggccttgctgatttcctcctccagcccctctgtttgtgtacgcacatacacacatgcacgcacgcacacgcacacccagtgcaatttctctctgctccctgtactccccaaaattcaatgggttcctctttcctcctcagagatatagtcctgggccccatctcagcctgcagaggcctgaacgtttcccaggattgtcttctaattctcaggtccggctttaaaacaaaacctaaactaaaactaaaatgctttctgcaaagaataatacaccaacataaagtccgggtatccta

SEQ ID NO: 402031 - DNA, 338 bp, Homo sapiens
atcctttgttctcattatacatcagaatgtctgtgtacagcagttaaggcataaaggaaagtaaaaatgcagttgaatctcaatactgtattttgcttttcagaactgcaattcttcaatttacattaggcatttaagattgttcaggaagcaaactaaaataataaaacaaaatgtccttaaatgtaatctcctttacttctacatcacgccagtgtgctactgggtatattatatatcctcccaatatatatttaaggaggtggtatgggtccaatagtaagaaaattttcttattttttcctgacaatattctgctaaaaatcatttgaatatgc

SEQ ID NO: 402032 - DNA, 212 bp, Homo sapiens
actcctgacctcaggtgatccaccctcctccacctcccaaagtgctgggattacaggcgtgagtcacaatgcctggctgatactttaattggaggtttttgttttgtttcagttacgaaactttcttctgctccttgaactcttcttttgtactgttttggcctgtctttcgtgttagtgactttatgtaaaaatctggtgattctcagcct

SEQ ID NO: 402033 - DNA, 285 bp, Homo sapiens
gagacaagcaggacaaaattcaaagcaacgagttaaagtaaaaacaaggttaggcatttcatgaccaaagccccttcgcctggcagcaagagagaaattcatacctcaccaagacccacacctctaacccttccccactgacaatccaccgcccagaagaggtatgggtcttctgctcttgcggcccccaagcccactccctgtgctgctgaggcttgacctccattccatcacacctgctgcttttcctcccaagcaggagttcctccacctggcctaggtttg

SEQ ID NO: 402034 - DNA, 472 bp, Homo sapiens
ctgtgggaatctgatgatgatgggtaatggcaactaacatttgagttactataccccaggcactgtgctaaacactttacatggcatatcctcacagctttcccatctagcagggaatattaggtacattttagaggagaacattaaggttgactgagccaaagtagcacacccaaggtgtgatacagcctgcgttcaaacccaggttgtcccatactctagagactgtgatgttaggacaaagtgtgatttcagaagatttgtaaagagaagaaagttgttagaatcacttctctaaagcatgctgattttgagattgctaaaattagaaactgtaccagaatttacatgacactttgtttggttttgaattaagtcattatgaggaagtacattaaaaaatgttaaaaggttcttcctgggaatttgtaatgcattcttcagttctaataaatgtattcttatatgctgg

SEQ ID NO: 402035 - DNA, 350 bp, Homo sapiens
ctgtgggaatctgatgatgatgggtaatggcaactaacatttgagttactataccccaggcactgtgctaaacactttacatggcatatcctcacagctttcccatctagcagggaatattaggtacattttagaggagaacattaaggttgactgagccaaagtagcacacccaaggtgtgatacagcctgcgttcaaacccaggttgtcccatactctagagactgtgatgttaggacaaagtgtgatttcagaagatttgtaaagagaagaaagttgttagaatcacttctctaaagcataagcttttaatgctgtaaaatatagtcgctgaaactttatccacttt

SEQ ID NO: 402036 - DNA, 112 bp, Homo sapiens
gtcttcccctccatcgttgggcaccccaggcaccagggcgtgatggtgggcatgggtcagaaggattcctatgtgggcgacgaggcccagagcaagagaggcatcctcaccc

SEQ ID NO: 402037 - DNA, 387 bp, Homo sapiens
aagcaaattcctaaacctagggatctgtgataatactgatgtcataaaaataatcagatttcagagctaaacatggactgttttagcaacaatgattaaatgttctgcatatggcaagagctccctaacgcactactaatatcactgtaaccatcatttagagtttagtaatcaccatatttaggtcatttttccaaagcaccaaggagactcagactccaaataggtttaatatctcaagaggactctacatggttgttggtgggacactgctgtgttcaggtcccaagaatccaggagtatgtaagtgaagccacttggtatttaacgataccctgagaaaatgaacaacacacacctccctaagaggcctccctttgtcgccgg

SEQ ID NO: 402038 - DNA, 266 bp, Homo sapiens
caatatacgaaaaatacttcctcgattgcctggcatataaaccctcaataaatatgttttaagatatatggttttccccaacatgatgataatttaaggaagggcgagaatcacatcttctgaattctttctaccttgagttactagagaaatatcttgggagtattcgatgctaagtatatgtttaggaaatgggttgatatttaaaataatcattattactaaaaaacacactgggcaaggcaaaattttcatgggctggagaa

SEQ ID NO: 402039 - DNA, 410 bp, Homo sapiens
ggggagaagggacaaggggacaaggtcagaggctgaagaagaaagatgcatcccagaggcagaacctgcagtgatggggctagactatggtggtggccgtggaaggggtgagaaggggcagaacaggacacagtgtgcagccagtgggcttggccggtggaccgagtgtggggcaagagagaggtgtcacggtgatgccagggcttggatgaagcctggagggctgacagtatccatggtacacacctcagtgggctccgaggggcatttgctctgattgattgattgatttttttcagatggagtctcgctgtgtctcccaggctggagtgcagtggtgcgatctcggcgtgagccaccgcgcccaggtttttgtttgtttgtttgtttgtttgtttttagagagggag

SEQ ID NO: 402040 - DNA, 968 bp, Homo sapiens
aatgaattcatcaattttttaaaaagaagcatgagatcaaaggtagaactaagtggtgaatttcacaaagtagacctaggcaatttcaaattggctgctatacttttcaaggtaaaggacacaaaccaaaggtacctatatattcttttcatgatatttatttcaaggagacagatcaaattaaaaacttcaagaatgttttctgcctggtaaataaatattccagcaacccacataggcacagactcagacacttagtccaatagaactccaaagaggttttcctgacactgagaagagggggtgagttttgggggaaaaatttttaaaaataaagtacttccagtctatatattgtaaactcacctattcatggatttgtgaaatttagaaacagcctaataaaaattctaggacaactgagttgtcacaacgtcacaagagcacaaattcatattgagtgacttttctagtaatatgaacaaaaccaacataaatttccctcaacatatcagaaataatatatattctatttagttccaagaaagaaaaaaaacttttataacttgagaaaactcaaaatatatgacaatctgtcactaaattaaaataagctatagtaataagtgactatgtaaaaaacccactacaactatgcgttcatcttcacgtacaaaggctatttctaaatgggtcagagtaaagctttggctgatacatgctgatggcagaatagggccagaaatgagccaaagctgtgtgtattccaaaactcattgatatttaaatctggagtgggtctttgtgcttacatttgaacatgttgtgagaacatgagcctcctgttgctttgtagtaatacatgctcattcttacaaaatgtttgccttgtatggttaaggtatttaactgaggctataaaaggagggcacattactttggtgggggtagaggagaatcaacacaac

SEQ ID NO: 402041 - DNA, 272 bp, Homo sapiens
tgttctggagggtcccggccggtggttataccattgatcagtgcccacgcaccaagaggcaaggattggacggtttctcattgatatttaaatctggagtgggtctttgtgcttacatttgaacatgttgtgagaacatgagcctcctgttgctttgtagtaatacatgctcattcttacaaaatgtttgccttgtatggttaaggtatttaactgaggctataaaaggagggcacattactttggtgggggtagaggagaatcaacacaac

SEQ ID NO: 402042 - DNA, 310 bp, Homo sapiens
cacacacacacacacacacttcactagagcctgtttgcagtaaccaaaaaaatgaaaacagggatctgattaaataaaataatgtacatctatgggactctctgtggcatttaaaagcatacagtggcaggtgcagttgagctctgggtcaccaagatgtcgttcccaaagtatactctatcacgcctggccactgtgcccccgaccctcaacccagccgaatacaacatatctccggacacccgacgggcgcaagttgagcagttggccataagagccgggctgaaatgagagtacctgcttcagtaca

SEQ ID NO: 402043 - DNA, 438 bp, Homo sapiens
gccctgcctgcagccctgttcacactaccctgtcaaagtcagatgccaaaaaagccgcctcaaagacgctgctggagaagagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402044 - DNA, 1961 bp, Homo sapiens
caaagcttctttcctgagaatttaattttatttgctgtagattcaaaatgaggaagtggtaaatgcattatttactcaaagcataaagtcagccttaggtaggagatgtaacaactcctcaactttacactatccagttaaagccaatttttaaaaccttttttttccttatgatgacccttgagtcatagaaaacttttcattttagaaaatgttaagcatgaacacaaaaagactagataacagtgttataaacactcatgtacccaaggcccagctttaacattcatcacttagcatgtttaaggtagtgcttaggttgaaatttatattgtgtgtatcagaataaagagcagttcttgcagatagctagaattacttcatttttatagagtttagagcataaactaacaagggaatctaggctctttatagtaaatatctaaaagcattttattttacagaattgacagcgtatgccatgactattccatttgtcaggcaacaggtttacaaaaaagtggaagaaaaagtgcgaaagcagactaaaggcctttatcctgcacctctgaaaataattgatgtgagtcttacccaatattcccacttttctcatatttccttcctttatatagatcactcctccttattgccattctggaccatgtatgttgagtactaaatttcttaattctgctattaaagtatttaccaaaaataagggaagggcatagcaagctgtaaggactcatataaagtgatatatttggggaaaatcagtgctggacttactcattgattgatgcagttaaatgtatcagtaacaaaccagaaaaccaggaaaggaacctaagtcatatcagtatcacaaagccattagagtgtcaggcactaaccaaaaagtagttgaaacaaaattgatggctctgttctattcttggtcaacatcattgtcagtacctaaaatccctcaaggacttcttcattgctgtaattataaaaaagatgtaatgatgtagagaagctctgcaaaagatcaatgagaataattaaaatgatcacaggattcaagaaatctccaacagtagactttaaaacttagaacttttcagtgtggaaagtccaagattaagagagtatataaccaaagacttcagaattggtgaatgggtcagtcagcaagtatatcttgagtagaaggcaccaaagcacataaaatatgaaacatgcccccacctgccttcgtctcacaggctggactggggaagttagatatatatatgtgttaaggtggatagcctttaagagatataaggcagcataagattaatgccagatgagtgggacagaggaggcaacaattaccatgagacaaagagatcagtaagtgcctcatgggatctgaccccaaccctgaaagctgggtggaggataggtgaaggagggaaagtattgccaaggagggtgggcatttagagcaaagttatggaagctggaaaacaagctcttcaaggaacattagtgagaccagtatttgtgggggataatgagatgttagtctgaagaaaggcagattgaagctggattttagaaggttggtaataatgaattgagaaattttacctttgtccgataaagattctagagagccattttcatggtagtgggtaaaaatggtttcgaaggagagacaaagtagagcagtgaattagcaaaactgtcctgataatccaggcttgagctttgaataaggccctgagatagaatagtaaaaataggaaagcagcaacaggcttgccaaagagaggttatgagttaggttcagatatatggagttcagatattttgggaaattcaagcaacagtagtttagacagagaagtcagagttagagatgtcaatttgcttatttctaaaaatttgtcattctcataaattatgatagtgagtaagtacagggt

SEQ ID NO: 402045 - DNA, 633 bp, Homo sapiens
tagttgtgcctgcattagttggtttattgaataacttaggcaatcttccactttgactgaaatgattaagatcagtttaccgaaagtcatttcatccttgccttgcaggcatctggctattcttggtgcagggctgatgggagcaggcatcgcccaagtctccgtggataaggggctaaagactatacttaaagatgccaccctcactgcgctagaccgaggacagcaacaagtgttcaaagggtaagcctgctctctctctttgcaagagttagaatgtcctttgtttcttggttagttgttttttgtggtggcttggtgggtttttttgtttgtttgttcttgccatcacggattcctttttcctgaacataatgagttctagatactccgtagtgaagccaagtttcttttgatttttagaaatgccaattccttctttgacttcgttttgttatagatatcatagacaattaacatccttggagtctgtagtctttgaatgcagaagggaaaatcttatctagtagatacttgttaatgccattttacactttcgtatcaggcctgcggattttgatatagtttgcaggtaattgctctattgttaaggattattcaaacagcatgact

SEQ ID NO: 402046 - DNA, 2638 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402047 - DNA, 2024 bp, Homo sapiens
gagttgactgatggctgggagctcctagacagtttcaggatgggggctggtggccagaaagaccaaggcatgattagaaggttggaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402048 - DNA, 1806 bp, Homo sapiens
  misc_feature (43)..(43): n is a, c, g, or t
acccacgcgtccggacccacgcgtcgcggacgcgtgggtcganccacgcgtcgggtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402049 - DNA, 1582 bp, Homo sapiens
  misc_feature (40)..(40): n is a, c, g, or t
ttcttatgatgcaggagacaatatccccaatcacaggtgnacgggtgctgacattagagaagcaagccattcagcaacagcttaggggaagagctctcaaatgtagtgttttcatactccaaagttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402050 - DNA, 3106 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagcctggaaaaaaaaaaaaaaaacaaaaaaaaaaaaaaaaaaaaaaaaaaaaaaaaaaaaaaaaaacaaaaaaaaaaaaaaaaaaaaaaaaaaaaaaaaatgttcgcccctctcggccaatgcgtttcaaactctgcccaatttaagcattgcgccccaaattcggcccacttgggcaatttcgcctattgggcgccgtttcacccttaatgcgccgcctttacacacccttccctgga

SEQ ID NO: 402051 - DNA, 2667 bp, Homo sapiens
  misc_feature (2645)..(2645): n is a, c, g, or t
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcaatggggntctgggatcctctagatcagcc

SEQ ID NO: 402052 - DNA, 2633 bp, Homo sapiens
  misc_feature (2616)..(2618): n is a, c, g, or t
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgaggtctcctccccccccaaccaaaaatattaannncctctttgttttcac

SEQ ID NO: 402053 - DNA, 1162 bp, Homo sapiens
  misc_feature (43)..(43): n is a, c, g, or t
acccacgcgtccggacccacgcgtcgcggacgcgtgggtcganccacgcgtcggcagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402054 - DNA, 1269 bp, Homo sapiens
ttttttttaatactttaagtcctgggatacatgtgcaggtttgttacataggtatacacgtgccatggtgctgtcttccattttctttgtgaccaccatacctgaacaggaggaccactcctgatgctggcatggtgctttccaagtggaaggccctcgcacgtgctccttggtctctgcccagcatctaggtgagaaccaggccacgtctggtgaaggccctcccctgctccagccttctctggcaagttcccagagagccgctggaaggacagattctccttggccccttcaccctcccagatctttattatcatttgtgagcagctgactgttgctgatgtcaaagagatactgattatcttctcggcaccaggccctgttctaggtgctcagtttcatgttaattagggcaagttactctccactttttccatgggaaagtttggttcacccaggcagcatcttctctgagggccagcaccaaccggcccacagagctccccatgcacccatcccgacttccattctgcatctgcggctctggctttcctccccttttcctcttcttctacctaaacatctctttctgttggcagctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402055 - DNA, 1356 bp, Homo sapiens
ttttttttaatactttaagtcctgggatacatgtgcaggtttgttacataggtatacacgtgccatggtgctgtcttccattttctttgtgaccaccatacctgaacaggaggaccactcctgatgctggcatggtgctttccaagtggaaggccctcgcacgtgctccttggtctctgcccagcatctaggtgagaaccaggccacgtctggtgaaggccctcccctgctccagccttctctggcaagttcccagagagccgctggaaggacagattctccttggccccttcaccctcccagatctttattatcatttgtgagcagctgactgttgctgatgtcaaagagatactgattatcttctcggcaccaggccctgttctaggtgctcagtttcatgttaattagggcaagttactctccactttttccatgggaaagtttggttcacccaggcagcatcttctctgagggccagcaccaaccggcccacagagctccccatgcacccatcccgacttccattctgcatctgcggctctggctttcctccccttttcctcttcttctacctaaacatctctttctgttggcagctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggaggttggtctcgcaggttgggaaggaagctcactttagcctggagcccgtgttgcgtctccttcaacgaagtcctctttctctattcagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402056 - DNA, 1955 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcggaaattgggaatgccttttaccattataggagggcgtgaaaaggaaggttttgattttgcaacggttgcctttaacgagtttgaactgcttctaatct

SEQ ID NO: 402057 - DNA, 1842 bp, Homo sapiens
  misc_feature (1730)..(1730): n is a, c, g, or t
  misc_feature (1732)..(1732): n is a, c, g, or t
  misc_feature (1734)..(1734): n is a, c, g, or t
  misc_feature (1738)..(1738): n is a, c, g, or t
  misc_feature (1745)..(1745): n is a, c, g, or t
  misc_feature (1749)..(1749): n is a, c, g, or t
  misc_feature (1751)..(1752): n is a, c, g, or t
  misc_feature (1757)..(1758): n is a, c, g, or t
  misc_feature (1764)..(1764): n is a, c, g, or t
  misc_feature (1772)..(1772): n is a, c, g, or t
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccctggggntncnttgngggtttncgantnngcggnnttgggncttgggcngtgggggccctgggctggtcccggtccgggatgggggctcagggggggactcgggtgcggccgatttaac

SEQ ID NO: 402058 - DNA, 1349 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggtttgaaggccgatgtgatgagctggtcgagacttagctagacaggttcagagtgacgggacgatcagtctg

SEQ ID NO: 402059 - DNA, 875 bp, Homo sapiens
gcggccgcctactactactactgctcgaattcaagcttctaacgatgtacggggacatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagcctggaaaaaaaaaaaaaaaacaaacaaaaaaaaaaatgtttttggggcggccctgggcctctcgaaaaagctttttcaaacaccatccccgtggggccgccgcggggcgccagtaggtgttacgtggaacacggggatcatcacgcggtggtcccgaaggaaaaagcagcgggggccacagcacaatggtgcctggagattctccccccagtttaaac

SEQ ID NO: 402060 - DNA, 1416 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcaggtaaacttatttcctttcaatgttttattatcagttaaaggaaaactaaagatccaatcctctgtataaagctgaaaaaggaaaaaaatatccaaagcctagtaaaaatttttttcttccagtgcttatcatctcttatgattaatctcagtgagcaagtggatgctaagaataccctaatggggccaggcgtggtggtttacccctgtaatcccaacattctgggaggccgaggtgggcagatcgtttgagctcaggagttcaagaccagcatgtgcaacatggcaaaaccccatctttacaaaaactacaaaagttagccaggcatggtggcatgcacccacagtcccagctacttgcagggctgaggcaggagaattgtttgagtccaggaggtcagggctgcagtgagctaagtaagatcgcaccactgcattccagcctgggtgacaaagtgagaccctgtctccaaa

SEQ ID NO: 402061 - DNA, 1134 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatctttaagtatagtctttagcccctaccacggagactggg

SEQ ID NO: 402062 - DNA, 283 bp, Homo sapiens
tgcgcccatgatgtctgaagtcatccgaatcctccaggttggtattgctctccagagtgtttgcggcatcttccactccttcagtcactctaaaactcatgatgtcaagataaggaccaagcttccttctgatacaccaactcctgctcttgtctaggaaggtccctggtgccctctctctgcacagcagtcggaagttgggcttatactgcactgaaaggggcagagctttccctctgccccacagcctcctcactgttccagcaagctaaaggcaccccac

SEQ ID NO: 402063 - DNA, 2335 bp, Homo sapiens
caaagcttctttcctgagaatttaattttatttgctgtagattcaaaatgaggaagtggtaaatgcattatttactcaaagcataaagtcagccttaggtaggagatgtaacaactcctcaactttacactatccagttaaagccaatttttaaaaccttttttttccttatgatgacccttgagtcatagaaaacttttcattttagaaaatgttaagcatgaacacaaaaagactagataacagtgttataaacactcatgtacccaaggcccagctttaacattcatcacttagcatgtttaaggtagtgcttaggttgaaatttatattgtgtgtatcagaataaagagcagttcttgcagatagctagaattacttcatttttatagagtttagagcataaactaacaagggaatctaggctctttatagtaaatatctaaaagcattttattttacagaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402064 - DNA, 2869 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcaaaaaaaaaaaaaaaacaaaaaaaaaaaaaaaaaaaaaaaaaaaaaaaaaaaaaaaaaacaaaaaaaaaaaaaaaaaaaaaaaaaaaaaaaaatgttcgcccctctcggccaatgcgtttcaaactctgcccaatttaagcattgcgccccaaattcggcccacttgggcaatttcgcctattgggcgccgtttcacccttaatgcgccgcctttacacacccttccctgga

SEQ ID NO: 402065 - DNA, 3088 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagcctggaaaaaaaaaaaaaaaacaaacaaaaaaaaaaatgtttttggggcggccctgggcctctcgaaaaagctttttcaaacaccatccccgtggggccgccgcggggcgccagtaggtgttacgtggaacacggggatcatcacgcggtggtcccgaaggaaaaagcagcgggggccacagcacaatggtgcctggagattctccccccagtttaaac

SEQ ID NO: 402066 - DNA, 2678 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcaaaaaaaaaaaagtcgacgggccgcgaatctagtagtagta

SEQ ID NO: 402067 - DNA, 2725 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggaggttggtctcgcaggttgggaaggaagctcactttagcctggagcccgtgttgcgtctccttcaacgaagtcctctttctctattcagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402068 - DNA, 2429 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccagtaccacaaatattcggacga

SEQ ID NO: 402069 - DNA, 2369 bp, Homo sapiens
  misc_feature (2362)..(2362): n is a, c, g, or t
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctttggacactcggcgtgtgcaggagntcctcta

SEQ ID NO: 402070 - DNA, 2414 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtcagtgagaaaccaaggctgctgctggctggtcctgtggacaccgaagcaggaaagtgagtctgtacagagagcaggagg

SEQ ID NO: 402071 - DNA, 602 bp, Homo sapiens
cggtggctgtctagaggatccctactgctggagagacatcggagcgtcttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtca

SEQ ID NO: 402072 - DNA, 1850 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttgggagcgggtttgagggggaacccaaaaatgtgaaacaaagggtcaaggttttctaggggg

SEQ ID NO: 402073 - DNA, 1949 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacacgaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagtgcttctaagtctgaagctcatcagacgaaacatccg

SEQ ID NO: 402074 - DNA, 1578 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaagggtaagcctgctctctctctttgcaagagttagaatgtcctttgtttcttggttagttgttttttgtggtggcttggtgggtttttttgtttgtttgttcttgccatcacggattcctttttcctgaacataatgagttctagatactccgtagtgaagccaagtttcttttgatttttagaaatgccaattccttctttgacttcgttttgttatagatatcatagacaattaacatccttggagtctgtagtctttgaatgcagaagggaaaatcttatctagtagatacttgttaatgccattttacactttcgtatcaggcctgcggattttgatatagtttgcaggtaattgctctattgttaaggattattcaaacagcatgact

SEQ ID NO: 402075 - DNA, 1445 bp, Homo sapiens
agccgcttttctgccttcaggatcctccgctcccgaggttatatatgccgcaattttacagggtcttctgcttgctgaccagaacccatattaactatggagtcaaaggggatgtggcagtgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagtaagttaaactctacgtaggaagcccttgtgaattttactgtgtgcaaagttcacagaggctttgaagatctacagagctagatctgtatcttaattcagtcttgccctcaacttctttcctgagcacatttgagcccttatgtctactaaaaactttttggctttcaaagttctgcctgttctgagttttttccaaacccctctggtcattcctatagaggctttcttgtcacatattgatgttgcctagaagtctggtttaggtcccccttcccaaaccacacactccctctgcactgttcaatgatcatctctctccctgtgatttgagatgtcatctctgggaactcacacttcttcctcattaaaaaacataaaacctcattgtaa

SEQ ID NO: 402076 - DNA, 471 bp, Homo sapiens
agggtctataactttcaacacattttcaaagtttaagaatcactgagctgggtgcagtggcacttgcctacagtccctgctacttgtaaggctgaatggacgatcacttgagtccaggagtttgaagccagcctgggcaatatagagagaccctgtctcttaaaaaaacaaaaatcactggactagctgatagaacaccaatgttccttaaaagaatagtttggcagtgtcaacactgcaaaattttagtttgactttttgatatgtatatttttaactataatcataaaaccttgatatgggttgaaagtttttttcttgtatttttcctctgtgtgttttttatagactgtgtatatggagagagagagaaaaagaaaactcacccatgtacaagagcaagcaaatgatatagatgttctttgaactctttttaatattgtaactttttgtaaatttgaaattatttcc

SEQ ID NO: 402077 - DNA, 356 bp, Homo sapiens
acatgttagttattacttcttgaaaatttgctatcttccaagagaaatgatatgtgattctatcatctattagtttgtgtaaccatcactggaaactagagggatataatacggtatttgcaagccaaagaattcaggtcccttgtcaaagttacacaccagaagatagaatcaggaaagaaatcccagtcatcttacctccaaggccatggttgtttcatatgccaggatgctaagaaagtagacacagtttgcacttttgagaagtttggcaatcaagtgagggaaaataaataaagaggagggatagaacacaggggagaaaatacaagaggagaagagagaggagagggcag

SEQ ID NO: 402078 - DNA, 315 bp, Homo sapiens
tcagaagaggatgcactttaactccaatggcctggaacccaaagaaaacgagcctccatctccactggtctctgggattattgattacaacatgcccctcacctccacctacctgaagcagatgaagcttcgagtgatgaattcccaggagcagccatcctcactgtctccggcacctggcttcgtaaacactgttatcaccgtgctcatctgtgcccatgaagaatgaagcacaaaaccgcacaaacagccggaagcacagccccctggttttgtttcatacagaatggcactaaatccaggtcaccactagaa

SEQ ID NO: 402079 - DNA, 746 bp, Homo sapiens
agaaaacaaaagactgtgaagcttagttgcatctctcatactgacttgaggatcaaatcagcccattatgtaactctctgtacccatttcctcaactctaatgtgaggagacagggccagcagattttaaacgtcgattcagttcaattattcacttattctgtaacttgagaattagctgtgcaaccctgaaaaacaatgaaaaaggaaatctgtagcaaaaaaagatagtggtggcactttcaggcaaacagtaaagtgatggaggggaaattgacggaagtgagaatgcagaaagtatcataatggaaaacgtttgtgagcatggagagaaatcccagagacctgaaacttctgccagaacctccatcaatcctccatcaatctgttaatcgttgttaacagatttcattaattcagctgaaataaattacatgtgcatactgaggaagtaaatggaaaggttctgctaaatttaggtgggcagcatcaagccagtgctgtgaagcaatacagtgacagacagaacaagttacctgatggattaactcagtgctcttgggtttattaaaacagatttcttgggttggggcaggggagataagggaattatttatccctagaggggctccagaccaggagatgttactggggcatgagtaggctctggagagcgctgtggaaaactcctgctctccagtgttccggacatggataataaccaggtgttgtatgcaaaaataaaa

SEQ ID NO: 402080 - DNA, 739 bp, Homo sapiens
cataaaacagtaaaatagattattctcagattaagcttggtgaagacatatccaagttcacatttttctctaattctttcccatcatcatactggtccaaccctatcctcagattttgcttagaatacttctttatgggctggtcacagtggctcatgcctgtattcccagcactttgggaggtcaagaaggaaagatcgcttaagtcaggagtttgagaccagcctgggtaacatgatgagaccccatctctactaaaattagaagaaaaaaaatccagtcatggtggtgcactcctgtaatcccagcactcatgcagctgaggcagaaggatcatttgagcccagaggttcaaggctacgattaggccactgcagtgcagcctggggacaaagtgaaaccctgtctctctaaaaaaaaaaaacaaaactcaaagaatatttttctgaggtgggtgctgttgtctctgtggtgggtgctattgtctctctggtgggtggtgtctctgcagtgggtgctgttgtctctgaggtgggtgctgttgtctctgtggtgggtgttgtctctgagtgggtgctgttgtctctctggtgggtgttgttgtttctgaggtgggagctgttttctctctggtgggtgttgttgtctctgaggtggatgctgttgtctctgtggtgggtgttgtctctgaggtgggtgctggtgtctctggtgggtgctgttgtctctgtggtgggtg

SEQ ID NO: 402081 - DNA, 197 bp, Homo sapiens
gcccccatagctatcattctgctcatttttaaaagtcagcatttatacaactgtacactcaggagtgcaggaaatctcactgcttttaaaggtaacagccttttctaaattcctacttcaacgtcatgctagagacactcagcaacctgtatgttctcagaaacaactaaaaccaatctactctctaatgacctcta

SEQ ID NO: 402082 - DNA, 294 bp, Homo sapiens
ggcaaggtcttgccatgttgtccaggctggtcttgaattcttggcctcaagcaatcctcttgccccagccttccaaagtgctgagattataggcatgagccaccacacctggcccaaaaggcctcttgagggatgagctaggaggaggccagtagacaggagggtgatgggccttgggtgagtcagagttttcctgggcatcttctgccaggagttggggcacgtgcatctgagatctttctgggagttgggagtataggaaggtgtcatcggggctctctgaggacatagaca

SEQ ID NO: 402083 - DNA, 451 bp, Homo sapiens
gcattcatgtcttgaataatttccccctcaaatataaactgatgtttctctgtctacaagactagtagtcaaacatctttggatggtcttgagacataccatactcatccatttaattcagcagaatctgagcttcactctcccctcaactaagatttacatgattataattatattgtttgtcatttttatcccttcctgtctgaacaaaaactgtatggaatcaacaccaccgagctctgtgggaaaaaagaaaaaccttctcccttcgctctgctggaagctggagggcgctaggcccctgtgcagtagtgcatagaattctagcttttttcctcctttctctgtatattgggctcagagagtacactgtgtctctatgtgaatatggacagttagcatttaccaacatgtatctgtctactttctcttgtttaaaagaagaaaaaaa

SEQ ID NO: 402084 - DNA, 574 bp, Homo sapiens
tcctgtttatctgtttgtcttttatttgtcttgatattatatataagttggtcgaaatttgctacttagtaatgacacttttatgaattagaacaatggcagataaatcctctgctgaggctattatattcgcaacagggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggtgaatgtttgagacagctctaatgattctttacctctctaaaaggggagaaagtgagctgtaactatctccagtatatggaatagttaggcaggatgccattttgcccagagtatgagtcctatgcccttaaagctagatttctttacaaacatgaataattagagtttctctttgtctctttttctccagatgtagatccaaatctaccagttttggggcatgctcacattatgggatctgcattactaatcttctgtaggaatctgaaattatg

SEQ ID NO: 402085 - DNA, 589 bp, Homo sapiens
aagatttgagacaatagtatactatgtttatgctgcaggcttacattttaaaatttgtttctaccattagcaaaaggcagggaggagctattacgaataagtctacgtgagttggaattggctgatgatgttgaccttgcaagtatagcagaaaacatggaaggttattcaggtgcggacattaccaacgtgtgcaggtatgaattatcatggaagcataggtttttgtaagcataaacttctagtatgaagttttttggttttgttttttgagacacagtctcgctctgttgcctagaactccatctcaaaaaagtatcacatagagatgagttatatgtactcgttcacattgtaaaatattaatatgtcaatatgagtgatggttaaaaaaggtaataaaacacttttagggtaaacagcactatatctagaaccacaagaccaagggcacagtctaattcatgacatcaatggactcattcaatttgagccatggtttcagccagtgtaaatgaaagtatacctactcctgcatctcagccattcttacctgggcaaaggttttatatcagtgtaaccaaaacag

SEQ ID NO: 402086 - DNA, 441 bp, Homo sapiens
gataatttcaaagtctcttcacatgtgttctcttccactttaagttttccttaacaattcatcatatgaatagccagcccttttagagaataaggtcaacttttttttttttgaaacagagtctcgctctgtcacccaggctggagtgcagactccatctcaaaaaagtatcacatagagatgagttatatgtactcgttcacattgtaaaatattaatatgtcaatatgagtgatggttaaaaaaggtaataaaacacttttagggtaaacagcactatatctagaaccacaagaccaagggcacagtctaattcatgacatcaatggactcattcaatttgagccatggtttcagccagtgtaaatgaaagtatacctactcctgcatctcagccattcttacctgggcaaaggttttatatcagtgtaaccaaaacag

SEQ ID NO: 402087 - DNA, 2553 bp, Homo sapiens
taaagtgtttctttttttcttcttctttttagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402088 - DNA, 2809 bp, Homo sapiens
  misc_feature (39)..(39): n is a, c, g, or t
  misc_feature (76)..(76): n is a, c, g, or t
gtgccctctcccccccgtttgtccccccccgcccgctgntcccggtccggccttcccgggctcggccccggccctncccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402089 - DNA, 2850 bp, Homo sapiens
agcggctcgctcccggggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaaacaatggcagataaatcctctgctgaggctattatattcgcaacagggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402090 - DNA, 2127 bp, Homo sapiens
tgatgagaggcatctctaggtaccatccctgacctggtcctcatgctgccgaggctgttgctgttgatctgtgaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaaacaatggcagataaatcctctgctgaggctattatattcgcaacagggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402091 - DNA, 2770 bp, Homo sapiens
agcggctcgctcccggggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctttccaaatacagaggagaatctgagaagcttgttcgtcttctgtttgaaatggctcgattttattctccagccaccatatttattctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402092 - DNA, 2315 bp, Homo sapiens
aaagaaagggatgatttgcaaatgaaaaagaggcttctcttaccagaagtgtgctgtgcagggagaaccaattggtgtcctctaccgtaccttcctgggccagctaaacccaggacacatagcctttccttgaagtcagatcattctacataacctcagtatgtgggaagaatcagtctagtcacttttgcttggtgtggcaacagactgaagtttaatttttgttgatgtaggtgcttttgatagatgcttcctaaaattttagttgagaattttcttggatgttttaatgatgatgaagttcactctttccctctctccatttgttgaaaaagtacaaaaatatttatacataaagacccaagtattgactctctttaaagatgaaattatcccactaggtacagtggctcattgtaatcctagcattttgggaggccgaggcaggaagattgcttgagtctaggagtttgagaccagcctaggcaacataataagacaccatctctaccaaaaatataaaaataagcctggtgtggtggcacacacctgtagtcctagctactcgggaggttgaggtgagaggattgcttgagcccagcctccctcagctattttctgattgctaatctgtagattattttaaaatgaaataatagcttaatagcttgatattgcatggtttcttcctttaggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402093 - DNA, 2676 bp, Homo sapiens
agcggctcgctcccggggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402094 - DNA, 2323 bp, Homo sapiens
gtccccggcaccggaagtgaccctggcgggtttgtcttcaaattctcggcgagcgtgagccaccatgcccggccccacatacattttgtagtcagggtcacaaattctggttttgttggtgttagcaggtgctggtaagatatctggtatctttcatgtcagtgaagagtctacagttcatttgaaagctacaagttcaagaagctaatgttaggataaattgtgtaaaatagaaaatcagtaattgtcttggattaaataaattgttggtgcctttgttcactatattataaaatacgaaatgattgtgaaatatattgacttggcatatgcacagaatacagtctcattctcagtgaacttatcctaaatgtgacagaatagcagtaaaaagaaaaaaagaatgtctttaatccagctggttcaagtaggttttgtcctaatctaagtattagtagagacacttaattaaccaggggcttgactgcgctcgtttcctcctttctaaagtgagcataccacacagggttctgaggattaaagctaaagtgtatacatcaaacagctctattgctatccctttgcataaatggtggctgctattaaggataaaacttggtaaaaggcaagagctgtttgaatctgaagttttgttttttttttttaacacaaatgagaaaaggagaaaccctgaacttacctagcttttcctctacatggagaaaatatttaattttcttgttaacagtttctcttctcttctgactctgtgatgcttattcttcattttattgaatagttataatgaaattcaaattgctagctttaaccccacttttactttttctgggattttatattcagtattaattatttaaattagcatcctttttcattacagaagatttaactgcttaaaaatcaatcacaacaggctttgtattccaataagtttctatacaatactacatatatatgtaatataattagagaatgctacaacagatcaattgaaaatttttctattaacaggttttcatttaaccaaagtaacattgtgtgtgttgttgttgtttttaacttaaaacctagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402095 - DNA, 320 bp, Homo sapiens
ttttagtagagacggtgtttcaccatgttgaccaggctggtgtcgaactcctgacctcaagtgatccgcctgcctcagcctcccaaaatgctaagattacaggcgtgagccaccatgcccggccccacatacattttgtagtcagggtcacaaattctggttttgttggtgttagcaggtgctggtaagatatctggtatctttcatgtcagtgaagagtctacagttcatttgaaagctacaagttcaagaagctaatgttaggataaattgtgtaaaatagaaaatcagtaattgtcttggattaaataaattgttgg

SEQ ID NO: 402096 - DNA, 240 bp, Homo sapiens
catgtcagtgaagagtctacagttcatttgaaagctacaagttcaagaagctaatgttaggataaattgtgtaaaatagaaaatcagtaattgtcttggattaaataaattgttggtgcctttgttcactatattataaaatacgaaatgattgtgaaatatattgacttggcatatgcacagaatacagtctcattctcagtgaacttatcctaaatgtgacagaatagcagtaaaaag

SEQ ID NO: 402097 - DNA, 2803 bp, Homo sapiens
agcggctcgctcccggggcgacgccccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402098 - DNA, 2592 bp, Homo sapiens
actgacctcggtgtgtgtgtgagtgtggtgaaaatcaagtgggagggaaagtgagcgggcacctgaacaagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402099 - DNA, 2635 bp, Homo sapiens
  misc_feature (39)..(39): n is a, c, g, or t
  misc_feature (76)..(76): n is a, c, g, or t
gtgccctctcccccccgtttgtccccccccgcccgctgntcccggtccggccttcccgggctcggccccggccctncccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgccaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402100 - DNA, 2352 bp, Homo sapiens
  misc_feature (39)..(39): n is a, c, g, or t
  misc_feature (76)..(76): n is a, c, g, or t
gtgccctctcccccccgtttgtccccccccgcccgctgntcccggtccggccttcccgggctcggccccggccctncccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaaattctcacatgtaaactgtgagaaatgtgccttaagtgtttgaatattaaatgcagtaattcattgtactgagtgctatattttttttaactttcataatggtaagattttttttaaaaaacccttatgattctgaataaaggcaatatttttaagctgaaaatttgttttactttagcattactagatttctattattatttcactgaccacaaatgttacttagcttggaaagctgtcttttttttctttgctttttctatttttttcaagactgtttgtttcttctagctgaactggccattcatactgggattagccaacagaccataagaaagacatcaatcttggctcttgtttgaaaccaatagctacaatggcaaaccatcacgtttcttgattcagggcctaggaaagctgactttatatgcacttttttttttttttttttttggtatataaactatttattaacagacaaggcctacagacttacttcttcttagacacacccacgatgcggccacggcagcctgtggtcttggtgtgctggcctcggacacgaaggccccagaagtgacgcagccctctacgggcccgaatctttttcagtcgctccaggtcttcacagagcttgttgtccagaccattggctaggacctggctatattttccatcctttacatccttctgtctgttcaagaaccaggctggcatcttgtactagtgtggattctgcataatggtgatcacatgttccacctcatcctcagtgagttctcccgccctcttggtgaggtcagtgtctgctttcctcaacaccacatgagcatatcttcggcccacacccttaacggcagtgatggcaaaggccattttccgccacccatcaatgttggtgttgactactcggcaaaatatgctgggacttttcagggatcactagagacatggcggcagcacaagtggcggcatgtaggcctcctgtggaagagagctatatgcacttctaacttggcatcttctctccta

SEQ ID NO: 402101 - DNA, 442 bp, Homo sapiens
aatcagttagagaagacagccataaagattcagtcatggtggcgtggaaacatggtgcgccggacgttactgcaggcagcactcagagcctgggtcatccagtgctggtggaggtcaatgcaggccaagatgttggagcaaagacggcgcctggcactaagactctatacctgccaggagtgggcggtggtgaaggtgcaggcacaggttcgaatgtggcaggcccgcaggcggttcctccaggcacgccaagcggcctgcatcatccagtctcactggcgctggcatgccagccaaacccgaggcctgatccggggccactatgaggtcagagccagccggctggagcttgacatcgaaatcctcatgacctagggcgctgacagagccaaggaggctggatctctcttccaataaagacccttactgaccatacacttgc

SEQ ID NO: 402102 - DNA, 599 bp, Homo sapiens
tgtgcctggccaaatgttcttgaaagaaattaaaagtgctactccaatgaacatacaagtggtaagaaagcaaaacagccctattgctgatatggagaaagtttgaatggtttggataaagatcaaaccagccacagcattcccttatgccaaagcctaatccagagcaaggtcttaattctcttcagttctgtgaaggaagctgcagaagaaaaaggtgaaagaggtgaggaagctgcagaagaaaacctggaagttagcagagcttgatccagaggtttaaggaaagaagccatctccataacataaaagtgcaaggtgaagcagcaagtgctgatggggaagctgcagcaagtcatccagaagatcttgctaagggtatgcacagatgtggaaacaggaactgatgtgtccattacaccactaggacagaggccagaacaatgaagaaaccaaatacttggaagagggtagagataatgaatggagtccaagagccctgattgtgccataaatgtccagataattccatacctgaggattatgtggtttgtaaacttggcacttagaagaaccaataaaatcatgttatagtttca

SEQ ID NO: 402103 - DNA, 886 bp, Homo sapiens
gaactcctccaaggcaagaaatctgttttgaagcttctctgcgttcacacacagcagcctggtttcctggaagggcattttccacattgtgcgttatggatgatcatcccaggcatcaggtgtgaagccctgcatccacatccaggggctatcaaatctctctgcaaaaggagaagctggactcaggctggaatgcagggatgcgatctcggctcaatgcaacctctgccgcccaggattcaagcgattctcctgcctcagcttcttgagtatctgggattacaggcacctgccaccacgcctgactaatttttgtagttttagtagagccagggtttcaccatcttggccaggctggtcttgaactcctgacctcgtgatccacccaccttgtcttcccaaagtgctgcgattacaggcgtgagccaccgtgcccggctgaccagtatctttcatgttactattgtaattgtttggggtcaccacgaaccgcacacatataagacaatgaacttaatcaataaacgtgtgtgttctgattgctccaaaaaaaaaaaaaaaaaaaaaaaaaaaaaaaaacaacaaaaaaaaaaaaaaaaacaatgactacaaatacggagagaacacaaaacgaacgacgacggggggggagaaaattaatctgtgaggaggaagaataagatagactcgaagatgttcgttaaagggtgggcctcctaacagggttaataaataaaagagaggtgagggtcaaactgtgtgggagagaagcatatgtgtgagtataaaagaaccaacttgggggggatggtggcaacacagaaggtataggtgggaatatagcataggtatgagtcaacatggggggagtgtgtgtattaatagt

SEQ ID NO: 402104 - DNA, 408 bp, Homo sapiens
gaactcctccaaggcaagaaatctgttttgaagcttctctgcgttcacacacagcagcctggtttcctggaagggcattttccacattgtgcgttatggatgatcatcccaggcatcaggtgtgaagccctgcatccacatccaggggctatcaaatctctctgcaaaaggagaagctggactcagggtatgcacagatgtggaaacaggaactgatgtgtccattacaccactaggacagaggccagaacaatgaagaaaccaaatacttggaagagggtagagataatgaatggagtccaagagccctgattgtgccataaatgtccagataattccatacctgaggattatgtggtttgtaaacttggcacttagaagaaccaataaaatcatgttatagtttca

SEQ ID NO: 402105 - DNA, 434 bp, Homo sapiens
gaactcctccaaggcaagaaatctgttttgaagcttctctgcgttcacacacagcagcctggtttcctggaagggcattttccacattgtgcgttatggatgatcatcccaggcatcaggtgtgaagccctgcatccacatccaggggctatcaaatctctctgcaaaaggagaagctggactcaggcacgtttacagtgatgtgtatgcagggtatgcacagatgtggaaacaggaactgatgtgtccattacaccactaggacagaggccagaacaatgaagaaaccaaatacttggaagagggtagagataatgaatggagtccaagagccctgattgtgccataaatgtccagataattccatacctgaggattatgtggtttgtaaacttggcacttagaagaaccaataaaatcatgttatagtttca

SEQ ID NO: 402106 - DNA, 469 bp, Homo sapiens
tcaaggacacagataatacaattaagatatcatactattttgtctcaaattatatacaaaacattttcagaataacaatactgataccattaccaatgtcattaaagaaaagtttaaaaagtttgtgtatgtggccaggtgcagtggctcacgcctgtaatcccagcactgtggaggccgaggcgagcggatcacaaggtcaggagtttgagaccagcctggccaacatggtgaaacaccatctgtactaaaaatacaaaaaaattagccgggcgtggttgcaggtgcctgtaatcccagctactcaggagactgagggcaggagaattgcttgcatctgggaggtagaggttgcagtgagcccagatcgagccattgcactccagcccggcaagaagagcgaaagtccgtctcaaaaacaaacaaacaaacaaacaaacttaaagtgcactctcaccctactttccct

SEQ ID NO: 402107 - DNA, 717 bp, Homo sapiens
aagaagctggtccttagcggggcgctgcggacaacctttcggtggccagctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgcttacctcacgttagttttttatattctgcaaagacaaaaccaaaaatgtctggatcatcttttcttacattggattataacgcaggaaacactgtgaagtaagtaaagttggaatccaagtcaaagaccatttgaatatttacaagtagatttgaggcaggaataatacagggtggccgcagggtaacaaattctaggcagcagatttacatgacttgaggctatgggctgataagac

SEQ ID NO: 402108 - DNA, 231 bp, Homo sapiens
atggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaa

SEQ ID NO: 402109 - DNA, 368 bp, Homo sapiens
aaacattcagcagatgtttactgactgccaactctttgaaattcatggcactatgttttgtaaagaagtacagtgctatctgtaatagttgacagtacctagcccaaattaataagtgcaaaaaaaaaaggttgtatagtgccaaaaaaggtaaatgccacagacattcccagattgaactcaagagcgccttaaaacaagagctacatcttatctttctttatatccccagtacctagcaccctgcctggtatttttttaaaaaagggttgtgagttaattaatagatgattgagtagcatgcatttggcaggggggcagttataagaagattcatggaagaaacaaaatgtgagttaattataaaa

SEQ ID NO: 402110 - DNA, 529 bp, Homo sapiens
cttttcctcaaaccagctggtttagatattttagtacaatgctttcaccagaacctacaacaatggttcctattaactgagaactgaaattgatgtggtctcctcatgccacaggtcacatgttgtttggtgactgattttgactctcaggaggaagtggggttgctgttacaccacggaggcaagaggagcagtaatagaacacaggagatctcctgaggcacctcatcactctcatgccagggcacaagttgatggcaatgtactgtaccacctacagacaaactacagacaacctacctacaggcaacctcctcaagaacaaaagcttgcttaacccaaccaggcaaagaatcctggccagctgaggggttgcgtgaaggaaagagggacctggaatggttagcggagaaggaaaattgtaaatgacaataaagcttcattaccagttacaaaaatgaagatcgtaacctctaacagtatttcccttcttgctgtattatatataaatggagtttttagctattgt

SEQ ID NO: 402111 - DNA, 446 bp, Homo sapiens
tgttagatatttcagaaagtgatgtgagtccctgaggtcatactgcagcgttcaggttctgtttggcctcctgcacgaagctttccttgattggaaaagctgcatactctgaagcacatcgcatgtgtcctgtctgtagttcatttcatttccccagatttgttatcatccaccatcactcatacaagcctaccttcttcatgccaacctttgtaatctttctaccttgctaacctggtcatgtcaaggaccagctaataaatagcaaagttgtaccttgagccaaggtatcttgactcttagtccagtgctctttatatacctctgaagtcttatttgagcttcaaaattatgagtctgtgctctcaagatttttttgaaaatgtacttaatgttgcccctaagcttttatgagaaataataaagttctttccagattgaatatc

SEQ ID NO: 402112 - DNA, 717 bp, Homo sapiens
catgagagagcagtcatttcagctttttcaccattgtgatctctggttaataaattaatgaagttgatttattagtattacttttccatagatttattttgatgctcttcaggtggctttcggattaaaagtgttttcttccttgtaattttttttcatttttataaactaaagggaaaaaaaaggctatggattgtactttggtaaaattttgactgtaacccatgtctatatcgtttgtcactaatttctgaaggccttcacatgaaatgtaatcaatgattcttaaagtaaaacattttgattattgatgatttctaatgagtctgtagttataatttggaagagtttttaatatatccattatttaagagagtttttctacatttctggtgctttaatttcttattgctactaattattagctgataaaagttaattggcttttacaatttctgccttttaggatttgtagaataatttttacagctctatgtgtgatatttatgaatattctgtgaatattgggtaaattatatattctccataggataatgatattattcaaatatattttacttaaatttttttggtcaaggattcttactgctcttttgctcttttcattttccctgtatatgtaaattgttttcacttcatttgtattacattttatgagacacaggtgtttatgcattatgcctatatagtaaattt

SEQ ID NO: 402113 - DNA, 472 bp, Homo sapiens
agcattgattgatattcacagaattgtgagccaatttttgatggttgttgctttaaaatattaaatttggggatgttttgctaggcagcaatagaaaatggatacgaaaatattttcgtcaaaaaaaattagattaacagctgatcataatacttaagtattaactttttcttaaactttagaatttaagttgcaggatatcaagaagagtaaacatcaaccaaataatctgcatcctcttttagagaaaggaatagtgtgttttcggctacatgcaagatagttctttcatgctaagcagaagtatgactttgttactgtctttatttggagattaataatggtttaaggagatgtgtatgggtgccaagttgataaagagtagacttgtgattgttaatttggttgggccacaccacagtgtccagatatttggttaaaggttattctggatatttctgtgaggggtttt

SEQ ID NO: 402114 - DNA, 325 bp, Homo sapiens
cagttgtcccaagtactcagggcacttggagtaaattgggagctgcattcagcatggagaccgcaatcctctggactgatggaaaggaaaaatcaaaccgttaaaacagttcttgccaaacggtgtcaggaaactcaactgaaatggatttagggctttggccttgcactgctctggattaattgcctggctgagcatgggacacatttgataaatgttctacattcacttaaagaaatgtggattctccaggtgtttggtacagcattccatgtatgttcagtatgtgaatatttataatcttgtataaattcatgtattctaa

SEQ ID NO: 402115 - DNA, 395 bp, Homo sapiens
attaaattgtttttggatttaattttccaatggttctttgctagaatatagcaataccattcatttttatatagtgacctcactgaccttctcttctgaacacatttatatatgtaattacatttatataaatgcaattatagaaatctatattacaggtatttgtgtttatatattgctctgctaacatacaaacatatttatgtaatgtaaaagtagttagagtaggagaggggaatctccgcatttactctggaatactgacatatcaaagcaggttaccaggggctttatttacaccaaatttggtagaaataatgatgatatgctaaggaattaattagctctagcatcaggtttcttaaaccagaaacggagatggacaaagattacat

SEQ ID NO: 402116 - DNA, 524 bp, Homo sapiens
cttgtttaagtattatgcacttgtctgtgtgacattttgtaaagcggagaaaaattaaggagaaaggaattgtagaacactaacaggaagaggacagatactgaggaatggctcatggtataagtgagattatcagagactttctacaatggaatttgaaatgcagggagcacatttggtgtatggttgtagaggacttacactaaagggcattcttcggctacctctgccagcagatgagcggctcctgagaatgcataccaaattaattccccagctgttcacatgcatataagcagctgctgctgttactgcctaacacttaatggcagtctggcagcacctctaatctctgccatagcagacaagccactcacctaaggcctctgctgtacttccaaagaaagaatttctcaagtagagactgagtagaactagactgccagctgtgagcctcagagctcctggctgcctgttgctgagtctatcagctgctgagcctttctcaccacaaaaaaaaaaaa

SEQ ID NO: 402117 - DNA, 1182 bp, Homo sapiens
ctcagcctctgagtagttgagactagagatacacacaccagtaatggtccagcccactaattagtgcacgcctggctaatttttgtactttttgtagagatggggttttgccatgttgccccagctgatctcgaactcctgtccttgagtgatccgcccgtctcggcctcccaaagtggtgggattacaggcatgagtcattgtgcccagcccatacacaacctctaaaaaatttttcataacacccaaattggtaaacatgttcaaaagatttaatgtacagaatcactagatacggtgagtttacggtttattgtagaagcaagtttgttttaatcatcttaggagatttttttgtgttgttttgtttttttgagagtctcactgcaatctccaccctccgggttcaactgattctcctccctcagcctcccaagcagctgggattacaggtgcctgccactgcacccggctaatttttgtatttttagtagagacggtttcaccatcttggccaggctggtcttgaactcctgaccttgtggtctacccgcctcagcctcccaaagtgctgggattacaggtgtgagccactgcacccagccatggagttatttttcattcataattgttatgtttgtaattttttaacatagccaataagaaaatacactaagtagatgaaatggtagatgtagctcttttcagctgagagtgggagaaaaagttgaggcacctaagggagatgaataaaaatgctagggtgtctgtcactttcacagtgaggagggctgacatgtagctgtgtgagcagtctactggagagagtggcttttctagaccatgacaattccctggcaatttagtttgaaccacattcacctgttaggattaccatgcgtattattaatgtcaactgaactaaatcatctttccatgacagctgcctaacaagaatccatctcacaaaattgaccacctcaaaaggaaattattttcatttcacctttaatgattattcaagaccccagtataacaacccaaggccaggcgcagtggctcacgcctgtaatcccagcactttgggaggccgaggcgggtggattacgaggttaagagatcgagaccatcctggctaacagtgaaaccccacctctactaaaaatacaaaaaataagccgg

SEQ ID NO: 402118 - DNA, 470 bp, Homo sapiens
ctcagcctctgagtagttgagactagagatacacacaccagtaatggtccagcccactaattagtgcacgcctggctaatttttgtactttttgtagagatggggttttgccatgttgccccagctgatctcgaactcctgtccttgagtgatccgcccgtctcggcctcccaaagtggtgggattacaggcatgagtcattgtgcccagcccatacacaacctctaaaaaatttttcataacacccaaattggtaaacatgttcaaaagatttaatgtacagaatcactagatacggtgagtttacggtttattgtagaagcaagtttgttttaatcatcttaggagatttttttgtgttgttttgtttttttgagaaatcacttgaacccaggaggcagaggttgcagtgagccaagatcgcgccactgctctccagcctcggcaacatagcgagactccgtctcaaa

SEQ ID NO: 402119 - DNA, 421 bp, Homo sapiens
tgcatgacctacaatcaaacaaagtaggtaagagaatttctttatgtccagttcttactcaaaaaggcaggggaaggttagagtagtattttatgttttatggctggctttggggatttttgggttctggtttttatgaaccactttgcagaagagaaattctagtttctgtggcttgtcttgaagaagaatgagaggtgaaagacgaaagcaggagagagccagaggaactttgcttttgaggctgcttctgaagccttcacttgggggcatcactttctgagcccccacagtgtcttctgatgaacagaaatgtttaatgttaatgaagtttaatttattagttttttaatggttagtgctttctgtaacctaggaaatctttacctgtcccaacattgcaaaggcattcccctatgtt

SEQ ID NO: 402120 - DNA, 2464 bp, Homo sapiens
  misc_feature (981)..(981): n is a, c, g, or t
gcaatatttggttcctattctttgacaaggataagctattgagaccaatcagaaccttccaatgtgtttccaatgttcttggctacatttctacttaaactcaaacctcaggaagaatataatctgttaagataacttttgtttttctcaaacattctctctctgcctatcccaaaagaatcaatcaatgctttatgttactaagttcactgattatgaggacaatgtctgaagatttcatacacataatattgggatcttccctttccttgaatttcagaatatgttggagccaatttctataaccaaaacgtagtatttgtgtatctttaaatgagctacaatccagaactgaaaatgaactatactaatggcatcgcacttaacaactttcaatgaagaaagaaataggttagagtctaagttcaaacacacttcaaactcacgtgaccacagtaaatcctacccttaaagcaagtacatatgtgtgtattgtttatgtttcttattttctgtatattatgatggttttgactcctttctggctgggaagagattgcccctctaggggccagccaacgcttagagaaggcaaaggactcagcgtgcctttcacatgcaaactaaacaatccacagcgatacctcctctacctgacccatacacccaggaggcaatattcccctgcctggtatctaccaggcaaactagggatcactcttacagtttagagcctgtatacctataacttattcaaagctactattattacacacctatagcttattagtagtagtagcagtagcatttacctacagctaatgcaaactagcgaatcctaaacttggttacccgccctgccttgcctttcccacagatactccagaaacggctgcagcccggtctctcttctagctcctgcccctttggcccctagaccaacactggggctttctcatgtggccctgaatggcatgctgngcctccgagaactcatgagtataataaactttgttttcctgagcccctcctgggtctccttttcacatgcacctgactgaccacataaaagaacacagaactctgtgtgtgtgtgcgcgtgtgtgtgtcattttcattttattttcccttgttcaggtggtcaataaaaaattattacacctttaaaaagaggtacctaaataaacaaacctaccaattctgtatgcaaaattaaatcctggactggcagtgttgctcagataacactcagaaaagaacaatgtgactgaaactgtaaggaacaggtcaaaaacactccatttaaaatgtgaacacctgctacagaatattttgattcacaagtccatctaggaaatatttttcttcctccctcacctgttcccccacctatcttgcattcaacaccataaacagcacttatcccccattataaaacagttgacggttaaaacaatgagccaaccaagaaagtataatactctataactgacatttactgcattggccttggacttctaatctttaccagacgggcacacaaatcaatccatcagctcataaaggtgtgcttttttaacctctaaaacagatgggattggccagaagtgtctggcatgtcaaactgctaatcactgctgccctttgcacaaaataacccacttaagttgaggcatggttgcactgtaaccgacattagtctgtgggaaacccatttaactgtcacacactcctgccactcctgctctcccttaattaagcctaatgccttatgctttgaccttttgttctagcctattaaccctatctagtacaagttcaattatgttaagctaaaaactttgctgtaaaatattaaatgccaagctcaaaaaatcataagggacatcctctcagccctaagttctattcaccctgatactcaatacatttgaaagtaaaacctcactttcgaagtaacgctgatactgaagcaaggagatgttgaatgactcacccatttcatagcttttccgtggcaaagcctcactaaaacctatctaatccctagctccaattctttaatctccatggtgcttctgattaatagttaaaccacccggaagtatgttaaggatactaacattttcaccccgaagtattatccttcgccatcctctagaatatgctatgcaaagaggcctaaaacaaaataaactgcgacttcagcagctgagaagtaatgattcctttcccctcccacacatcaaaacttcctatcctatcccctcactactttttttcctttttaaaagtaacaatggtcattgagaactactaaatcctacaacactcacaaggtagtatgtacaaccacagttttcccccgcgatacttcactgaagtattcaataccgccaatgacttaaactacagaaggtaattacaacttgctacttatcctcactggacacagccatttagg

SEQ ID NO: 402121 - DNA, 552 bp, Homo sapiens
cagatggacatttatagcaacttaaaatgagctacatgtctctgacctgttctagtctccattccctcagaatttgcctccaaatgagaatttattcattgaattaaggcagctttattagagacagtgaagaatccaatttcaaaattatgatttatcccattcagtttagagataggtgatatctgatggccctcaatgttagatgattgattaccagtatatcacatgggagcaatgctaaaatgcaaagaaaataccagatttggctgggcacggtggctcacatatgtaatcccagcactttgggaggcagaggtgggcagatcacctgagatcaggagttcgagaccagcctagccaacaaggtgaaaccccatctctactaaaactacaaaaaattagccaggtgtggtggtgcatgcctatagttcaagctgctcagaggctgaggcaggagaatcacttcaacctaggaggcagcagttgcaatgagccgagatcacaccactggcactacagcctgcgtgacagagcaagattccatctcat

SEQ ID NO: 402122 - DNA, 729 bp, Homo sapiens
aaccatgtaaagtaacactgaactgatttgtaaagtttgggggcaagtgatggcagttatgaacagtcacaatctaaactctaactttttgccattaaaaattacaaagtacctgttagaaatattttctaaatatttgaaaggtacattgtgaatatcttcatatttggaatgaagtgtgccttggcagtttgaacacttaggcagtcattaagctccatgtctatagctgctccctggaaatacagaagaccctcctccttggcaggacccattggcatgagaccccttgctaggctctgttttctcaaaatcctttcacatacagctgagtatatcatggtaagaggctcaggggacaataatattcaatatgtttctttatcaccaatggatatattttttaacttgaaggactagctagtcatgccatgtagcaggatcagaaatctctaatctttaggatgatttttttactttttaggaaaaagggctatatgcagacaggctggccctggtagtactttacaaataattttgttttattaccaagaaatatgtttgtttcttgtgacacattataacattatctgaaaggggtaggcaagagtttatttttatctgtatttaagttttaattacaaaattattataacatgcttgataaaatctcaaacaatctagaaagatactatacttgataaaatctcaatctggaaagataccaag

SEQ ID NO: 402123 - DNA, 1138 bp, Homo sapiens
tggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcgactcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccagcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgaatttacattgacactgaggttacactctaacttctttttccccaaatgatgatcattttccacaaaatgatggccagttattccaacactacttattggatcatttccaattcagtgag

SEQ ID NO: 402124 - DNA, 3267 bp, Homo sapiens
  misc_feature (2754)..(2754): n is a, c, g, or t
  misc_feature (2767)..(2768): n is a, c, g, or t
  misc_feature (2778)..(2778): n is a, c, g, or t
  misc_feature (2784)..(2785): n is a, c, g, or t
  misc_feature (2787)..(2787): n is a, c, g, or t
  misc_feature (2791)..(2791): n is a, c, g, or t
  misc_feature (2794)..(2794): n is a, c, g, or t
  misc_feature (2799)..(2801): n is a, c, g, or t
  misc_feature (2816)..(2816): n is a, c, g, or t
  misc_feature (2821)..(2822): n is a, c, g, or t
  misc_feature (2824)..(2829): n is a, c, g, or t
  misc_feature (2833)..(2833): n is a, c, g, or t
  misc_feature (2836)..(2837): n is a, c, g, or t
  misc_feature (2850)..(2850): n is a, c, g, or t
  misc_feature (2852)..(2852): n is a, c, g, or t
  misc_feature (2855)..(2855): n is a, c, g, or t
tggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcgactcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccagcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggcggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacacnactgcgccccccnnccccccaacnaacccnncngagnacnaaccnnnacacgaatataaagnacccnncnnnnnnaccngcnnaagggaaagatananagngggaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaaaaaaaaaa

SEQ ID NO: 402125 - DNA, 3346 bp, Homo sapiens
tggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcgactcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccagcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggcggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtattctctaaaattagagcttattgtttaatactttaaaaaaaaattctgataatacttctttgctttttaaccataggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaaaaaaaaaa

SEQ ID NO: 402126 - DNA, 3206 bp, Homo sapiens
tggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcgactcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccagcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattgaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggcggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaaaaaaaaaa

SEQ ID NO: 402127 - DNA, 462 bp, Homo sapiens
atgatgcttctaaaatctaaattatttccaatttgggaatagttcaaaattttttaaaatgctggcccttattagaagtatcagaaagccttgcctgcattcaatttaattggatttgggatgtcattttgtgatttaaattaatatgaaaaatatttatacgttggatttgccagtttttaaaaattttctgtttcttcagtttctaacactgtttacattttttattgcttagtttttttatgtcaacctaattagactataagtatcttgaagataaggtcaataaacactcatcacatttttgtcattgaattatttgcaatcaagctttacctagtttttttttcccccttaaatcacagaaaacattcaggaggaatactgttgcagctgaaattggtggggagttcaatacttttcaattaagttatttaaaaatattcttcattgatggaaagc

SEQ ID NO: 402128 - DNA, 490 bp, Homo sapiens
ataacatgtttttcatatgtctgtgtgtattaactttttgtaattgcctttagactaatttcccctcttacttgttttttcctctcataagtttttaatattctttgtcttaaaggtttaatatttgtgtagtatatttgtgtagtatatttgatacccagaggatgtctagaagctcaggagaatgatttttggactcattaatcattttggacacatttcttggtcattataacaagctaacaccctcaaagacttcagtgattaattttattttctgctttttaagccttttgggagcttattagccaaaatgtattgtcttttttaatactaactacattttactaactcttgttataggatcatagaactcaatggtggacaaccgcctctaacttataaaagattccagactctcatcagcaaaatggaaccactagagataccagtagagacaattacttcagaagtgatagaaaagtgcaca

SEQ ID NO: 402129 - DNA, 3267 bp, Homo sapiens
tggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcgactcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccagcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggcggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaaaaaaaaaa

SEQ ID NO: 402130 - DNA, 3999 bp, Homo sapiens
tggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcgactcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccagcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggcggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattaggtaaatattttagagctgtatttcttgctttagaagagtatataattaacataaattaagataatttcaaaaatggagcaaatctctattttcaaaccagaaaatcttgaggcattaatttttaagcagtttatacagactcagttaatttttggtcaagagacatgcatctgtactggagaaattgttgcaccagttttatattcatctgaaccaatgctctttaaattagagatgtttatgattttgtggtcaagttttttcttagaaaaagacaacttttttatttccttactatgtaactatgagtctaaaacaattaaagtggcctgtttattttagtgacattaatataatctttttatgaactttcccctaaatctttgcctcttaaatgttgataaatttcttttatctgttatgatgcttctaaaatctaaattatttccaatttgggaatagttcaaaattttttaaaatgctggcccttattagaagtatcagaaagccttgcctgcattcaatttaattggatttgggatgtcattttgtgatttaaattaatatgaaaaatatttatacgttggatttgccagtttttatttttttatgtcaacctaattagactataagtatcttgaagataaggtcaataaacactcatcacatttttgtcattgaattatttgcaatcaagctttacctagtttttttttcccccttaaatcacagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaaaaaaaaaa

SEQ ID NO: 402131 - DNA, 3129 bp, Homo sapiens
tggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcgactcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccagcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggcggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaaaaaaaaaa

SEQ ID NO: 402132 - DNA, 1598 bp, Homo sapiens
tggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcgactcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccagcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggcggagaaactgaagcacttactcgtttggaaaggcatttggaaagaaaagcttgggtggcaattttgaaagacctcgaatgatgcgtcacggggtcctctagg

SEQ ID NO: 402133 - DNA, 427 bp, Homo sapiens
atgcttgcttacaagtacttctgaccatatgtcatcatgatattcatggtgtacccatttatagcaatatgtgaagccagtggtaaaaagaatagagatctcaggatgttaattgctaagaaccagatcgattataataaaatcccaaagttgttttatttaccccaaattttccagaataataaatacccatggggaaacattgacactgatctctcatcctgaaggtcctttggagtgagaactggtcatgcccaagaagaacccaagtcctctccagattcttaagaataaccccagggtttcaggctgcaggccaaagagggtctctcaggttgcaaacgatctagcattctcctcctaagaggaaaacacttgggaaagaggaagattattagggaccctgagcagtattttgacccaactc

SEQ ID NO: 402134 - DNA, 523 bp, Homo sapiens
ttgtttccaagagaggtattccaaaagtgtttcaagcaatgactgagctaagcatccagtcctgcaaggtgaaggcgttgaagacgcagccctcatttgaatagatgaattgtggtattcttgttaaataatgaatcatatcaaggcttggtcacacctcatgcacatgaaaagaccaaaacgcaaggcagcatatcagcgccacgtgaagtacacactaagcaccaactatttaattcagcaatcatggggggcccggtggctcacgcctgtcatcttagcaatttgggaggccgaggcaggtggatcgcttgagcccaggagttcgagatcagcctgggcatcatggtggcctgcacctgtagtcccagctactcaggaggctgaggtgggaggatagtttgaccccagaaagttgaggctgcagtgagccgtgaatgcaccactacacaccagcctggatgacagagcgaaaccctgtctcaaagtaattaataataattatattaattcagcaatcatt

SEQ ID NO: 402135 - DNA, 1214 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagagctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcctaccgtgtacaagagagagccaaaaggcgaaaacagcaagaaagaaagacaacaaagagaggagaaaacacagcaaacgacacagaaacaaaacaaaaagaagagagagacaaagaaaggaacaccagaagaaacacagagcggagatgagaagaacaagaagaaaaaagaacaacaccacaagacacacaaacctgaaaacaaataacaaaacgaagaaaaac

SEQ ID NO: 402136 - DNA, 679 bp, Homo sapiens
gggtacaggtagcggaggctggagatcgcgaatttggagctgaggctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcctactggaaggccctccccccataacaaagggaagaaagggaaccaaaaaagagaagagagagaaaaaggaaaagggagcaccaaaagaacaacacaggaaag

SEQ ID NO: 402137 - DNA, 2744 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctggaaaacgagcaagccaaacaccccggggaactcaatcccggggcccgcgaaaaggaggctcccgaaatggccccgtggcctc

SEQ ID NO: 402138 - DNA, 2660 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatgcccccgatcgggaatcagagcggcgccgagggcgaccagatcaacgccagcaagaactaggagtacgcgggaaaaatgttcgttggtggcctgagctgggatatt

SEQ ID NO: 402139 - DNA, 2437 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagagctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402140 - DNA, 2030 bp, Homo sapiens
  misc_feature (3)..(3): n is a, c, g, or t
acnccgcctaaatacgccccccccttcattacccttaccggaattcccgggctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402141 - DNA, 2012 bp, Homo sapiens
  misc_feature (23)..(23): n is a, c, g, or t
caactacggctaggtacgaggcngggtggtaccctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402142 - DNA, 2018 bp, Homo sapiens
ggtctcttgagattcaaagggtttgtcacgaaacaatgactcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402143 - DNA, 2030 bp, Homo sapiens
gaaaaaaactacgctagggtacgagccgggtgaaatcggcgaggcggtcacctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402144 - DNA, 2029 bp, Homo sapiens
  misc_feature (13)..(13): n is a, c, g, or t
  misc_feature (16)..(16): n is a, c, g, or t
  misc_feature (24)..(24): n is a, c, g, or t
ttggctggttcgnccncgagttantgctatcgtcgacccacgcgctccgcctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402145 - DNA, 2718 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacagactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttgttttagccataaattataatcgaacctttcccttctgaaaaaaatttaatataataacccctggggggggcacctgaacaccaaaattacccttatatggtgtatttatatgaaaatacgtagggc

SEQ ID NO: 402146 - DNA, 2608 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402147 - DNA, 2235 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaaaaaaaactcgagactagtgcggccgctaagtaagtaagacgtcgagctctaagtaagtaagacgtcgagctctaagtaagtaagacgtcgagctctaagtaagtaagacgtcgagctctaagtaagtaagacgtcgagctctaagtaagtaagacgtcgagctctaagtaagtaagacgtcgagctctaagtaagta

SEQ ID NO: 402148 - DNA, 2319 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaagccgggcgcggtggctcacgcctgtaatcccagcactttgggaggccaaggtgggaggatcacttgagtccaggatttcgagaccatcttgggcaacatggcgaaaccctgtctctacaaacaatacaaaaattagctgggtgtggtggtgtatgcctgtaatcccagctacttgggaggctgaagtaggagaatcacttgaacccagggggcagaggttgcagtgaaccaagattgtgccattgcatgctagcctgggtgacagagcaagactctgtctt

SEQ ID NO: 402149 - DNA, 2828 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggatagcccaccagtgccccgtagtgaaagagctgcggaccctgaatggccgcacatgcgcattgatccccaagagggcggaggtgtaaaggcaattggaccgctcgggcgacgtagcatgcgccttggccctcggcgcagagccgcgtgtggacgggtggcgttcgggtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402150 - DNA, 1434 bp, Homo sapiens
ttatcctctgtctctgcttatcacctctctgcgtatttctggatctcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402151 - DNA, 1587 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402152 - DNA, 1602 bp, Homo sapiens
  misc_feature (1336)..(1336): n is a, c, g, or t
  misc_feature (1339)..(1340): n is a, c, g, or t
  misc_feature (1343)..(1343): n is a, c, g, or t
  misc_feature (1353)..(1357): n is a, c, g, or t
  misc_feature (1360)..(1360): n is a, c, g, or t
  misc_feature (1371)..(1371): n is a, c, g, or t
  misc_feature (1381)..(1381): n is a, c, g, or t
  misc_feature (1386)..(1386): n is a, c, g, or t
  misc_feature (1402)..(1402): n is a, c, g, or t
  misc_feature (1406)..(1406): n is a, c, g, or t
  misc_feature (1416)..(1417): n is a, c, g, or t
  misc_feature (1419)..(1420): n is a, c, g, or t
  misc_feature (1423)..(1423): n is a, c, g, or t
  misc_feature (1425)..(1425): n is a, c, g, or t
  misc_feature (1427)..(1427): n is a, c, g, or t
  misc_feature (1433)..(1433): n is a, c, g, or t
  misc_feature (1440)..(1440): n is a, c, g, or t
  misc_feature (1444)..(1444): n is a, c, g, or t
  misc_feature (1453)..(1453): n is a, c, g, or t
  misc_feature (1460)..(1460): n is a, c, g, or t
  misc_feature (1491)..(1491): n is a, c, g, or t
  misc_feature (1495)..(1495): n is a, c, g, or t
  misc_feature (1497)..(1497): n is a, c, g, or t
  misc_feature (1509)..(1509): n is a, c, g, or t
  misc_feature (1514)..(1514): n is a, c, g, or t
  misc_feature (1518)..(1518): n is a, c, g, or t
  misc_feature (1521)..(1522): n is a, c, g, or t
  misc_feature (1524)..(1524): n is a, c, g, or t
  misc_feature (1527)..(1527): n is a, c, g, or t
  misc_feature (1539)..(1539): n is a, c, g, or t
  misc_feature (1589)..(1589): n is a, c, g, or t
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccgncgnnccnaaaaaaaaannnnngcngcaactaaaanaaaaccactnccccncccccccccccccctncccngggctggttnnanntcncnangccctnttttggntctntggcttctngcctctntgccgcacgggccgggccggcgcctggggtncgcnangccccgcccagnggccntctnttnngnctngcgttttgttgncctccccctctgcccccgggggcggccccccccccccccccctggggttncgtccgccggccg

SEQ ID NO: 402153 - DNA, 1318 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcctactggaaggccctccccccataacaaagggaagaaagggaaccaaaaaagagaagagagagaaaaaggaaaagggagcaccaaaagaacaacacaggaaag

SEQ ID NO: 402154 - DNA, 1608 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtaagggcaggtggaaggtggagctggggagtggagggcaggggaagatgggggaggaagaactcatccatgtattcaataaatattgagtgcctacaatgtgccaggcactgttttaggtgctgaggatacggctgggaacaagaagaacatggtctgtgccttccagcagctcacactgtggggagtagaccagagataaattaaatgagagtgtattggaataagtcaaaaacacctagcagctgagctacaaaatgacaaaggggacctaatatagaatgggtagccagaaaaccttctccaagtaggtaacatgttgactgaggcataaatgatgggaaggaagccaggcatgatggcctgtaatcccagcactttgggaggccaagcggggagaattgctttagtccaggagttcaggacgtgggcaacatagcgagacctcatatctatagg

SEQ ID NO: 402155 - DNA, 1291 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcagctgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402156 - DNA, 301 bp, Homo sapiens
  misc_feature (3)..(3): n is a, c, g, or t
acnccgcctaaatacgccccccccttcattacccttaccggaattcccgggctcactacagtgtcgccgcctctgcctgcgtagccccggccatggctctgtagcctcgacccctttgtccccctggctccctatgaggtccttgggggagccctggagggcgggcttccagtggggggagagcccctggcaggtaagggcaggtggaaggtggagctggggagtggagggcaggggaagatgggggaggaagaactcatccatgttttcaataattaatgagtaaagatgaaacaaggca

SEQ ID NO: 402157 - DNA, 330 bp, Homo sapiens
ggtgtgttttttttttttctaaacgattcttcgtgcttggttgttcctgcgcagtagcccaccagtgccccgtagtgaaagagctgcggaccctgaatggccgcacatgcgcattgatccccaagagggcggaggtgtaaaggcaattggaccgctcgggcgacgtagcatgcgccttggccctcggcgcagagccgcgtgtggacgggtggcgttcgggtagccgttctccgcgtgccccctctaccctcctccaccctccctgccccacgttgctctggctcacagcccagcttccttccttttaaaccaggcacctgctgaggcggg

SEQ ID NO: 402158 - DNA, 954 bp, Homo sapiens
  misc_feature (649)..(649): n is a, c, g, or t
aagtaggctagtagagcggggttatggagaggctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcacacacaaaaaaaaaaaaaaaaaaaagacaaacaaaaaaaaaacaaaaaaaaaacaaaaaaaaaaaaaaaaaaaaaaaaaaaaaanacaaccagaaaaagaagagacccgaaaccacaaacacacaaccaaaccagagacaacacaccaaaaaacacaccgaaaagaaacgagaacaatacaacaacaaagacaaaaaaacaacaacaagctatagaccaagcaaaaaaaccaacaagaagaaccaaaccccacaaacccaaaacccacaagagcagaaaaaagcaaaaccaaacacaaaagaacacagacaaagacagaacacagaccaaaaacaccagacacaaaacaagcagaaacacaagaaacacaaacacaaaacaagaacaacc

SEQ ID NO: 402159 - DNA, 2663 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402160 - DNA, 2765 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctggaaaaaaaaatacataaaaaaaattgtggggcggcttgggcctggaaaaggtttttaaccacttcgtgtgggggggggcccagatgggttagtgcactggtca

SEQ ID NO: 402161 - DNA, 2564 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgattgggaggttatgagcaaaaataaaacgaaacatttcctctgg

SEQ ID NO: 402162 - DNA, 2595 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgccccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402163 - DNA, 2016 bp, Homo sapiens
atatagctaggtcgggctggggtgaaatcggccgaggctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402164 - DNA, 2034 bp, Homo sapiens
gtcctacggcatatgagatctcttgacgattcattattgttcccaaaaactggtactcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402165 - DNA, 2608 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaacgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402166 - DNA, 2032 bp, Homo sapiens
gggcagcggcagagcgaggagtgggatttgagtgaataacattgctgaagggctgcggcctggggcagttcccctgggaactggtttgggatggaagctaggaaggcagtggggccaaaaggaaatattttagaggaaggggcgtggctggaagaaaatgtccctgggattgagtttttccttgaggcgaaatattctgaggtggatgggaggggcctaaggtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtccctcccctcctttgacctcccccagccccctgtcttggatactctggacttgctggccatctactgccgcaacgaggccgggcaggaggaagtggggatgccgcctctgcccccgccacagcagccccctcctccttctccacctcaaccttctcgcctggccccctacccacatcctgccaccacccgaggggaccgcaagcaaaagaagagagaccagaacaagtcggcggctctgaggtaccgccagcggaagcgggcagagggtgaggccctggagggcgagtgccaggggctggaggcacggaatcgcgagctgaaggaacgggcagagtccgtggagcgcgagatccagtacgtcaaggacctgctcatcgaggtttacaaggcccggagccagaggacccgtagctgctagaagggcaggggtgtggcttctgggggctggtcttcagctctggcgccttcatccccctgcctctaccttcattccaaacccctctcggccgggtgcagtggcttatgcttgtaatcccagcactttgggaggccaaggcaggaggatcgtttgaggccaggaggtcaataccagcctgggcaacatagtaagaccctgtctctattaaaaaaaaaaaatcaacccttcttccccaccaaaccacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggacactacgctaagggagggaggctaaaggcggccaggtttgcagtgcgggaagatgagcaggccagtgggaggaggggcagggcagggctgtagttggtgactgggtgttcattttagctctaagaaaaaaaatcagtgtttcgtgaaggtgttggagaggggctgtgtctgggtgagggatggcggggtactgatttttttgggaggttatgagcaaaaataaaacgaaacatttcctctgg

SEQ ID NO: 402167 - DNA, 1582 bp, Homo sapiens
  misc_feature (1404)..(1404): n is a, c, g, or t
  misc_feature (1412)..(1412): n is a, c, g, or t
  misc_feature (1416)..(1416): n is a, c, g, or t
  misc_feature (1423)..(1423): n is a, c, g, or t
  misc_feature (1425)..(1425): n is a, c, g, or t
  misc_feature (1450)..(1450): n is a, c, g, or t
  misc_feature (1459)..(1459): n is a, c, g, or t
  misc_feature (1468)..(1468): n is a, c, g, or t
  misc_feature (1470)..(1470): n is a, c, g, or t
  misc_feature (1472)..(1472): n is a, c, g, or t
  misc_feature (1475)..(1475): n is a, c, g, or t
  misc_feature (1485)..(1485): n is a, c, g, or t
  misc_feature (1491)..(1491): n is a, c, g, or t
  misc_feature (1506)..(1506): n is a, c, g, or t
  misc_feature (1528)..(1528): n is a, c, g, or t
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccctcccaccaccctccccgccgccactaccaccaccaccactaccaccagccccctccctccccctgtctnttccttcncttnttttaantncccaactccttttttttatattctngatttctgncatttattncngnaanaggcgggcangaggantggggatccgctttnccccgcacagagcccctcctcntctccactcaacttctcgctggcccctaccacatctgcacaccgagggacgcaa

SEQ ID NO: 402168 - DNA, 1504 bp, Homo sapiens
tatgagttgagctctgtgcataaggcttgccagacatcgtcttatttgagtctcataaacccaccaggcgagttgatttttcttattttacagatagggaaatgaagtaagagaacttaagttatttgcccgaggccatcctggcaggtctgtatttgggagagtgctgtgactcatgctggactctaacccacgagggtttctcagagtcagcagctgggggatgaagaagtgaaaagtgactggcaggaaattctgcaagcaaggaaagggaaagagaaatgaactggtgcaggtctgcgggaagagaatgaggctggatcctcaaaatcacaggaggaagcaggcccagacctcagaggcagaaagagaaagaaaccagagcttagagtcaggaggaggaaaccagaccccggagccacaaggagagggctggatccccggctcagagggaagaggtcggatccccagctgagagggaggagggtcccggaccctaggagtgggaaggaaaggctcggatcccctgatccccaggaggaggggacccggctgcctcccggttggggccgcgcgagggcggggcgcggaaggatccgggagggccgtgctccgccacccagtatatatctgtccccagtccccggggccgcctcattccctgtcctcggatcacagtctcttctcactacagtgtcgccgcctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggagtcttccactttcgccttggtgcctgtcttcgcccacctgagcatcctccagagcctcgtgccagctgctggtgcagcctctcctgttgccatcagtgcccagcacctgtgctacagccatgtcactcctggcgaccctggggctggagctggacagggccctgctcccagctagtgggctgggatggctcgtagactatgggaaactccccccggcccctgcccccctggctccctatgaggtccttgggggagccctggagggcgggcttccagtggggggagagcccctggcaggtgatggcttctctgactggatgactgagcgagttgatttcacagctctcctccctctggagcctcccctaccccccggcaccctcccccaaccttccccaaccccacctgacctggaagctatggcctccctcctcaagaaggagctggaacagatggaagacttcttcctagatgccccgcccgcctattatcaaccgttgtgtcttgtggtaaacgctcctcatcttataagacttttcatttattttttgccttagtgcttatgaattctttgtatggtctttgctaaatctcaaattctttgccctggtattacattatatataaaggtgtctgttataccttttaaaat

SEQ ID NO: 402169 - DNA, 367 bp, Homo sapiens
tgttatgttttaatatttttagagatggagtctcactgttttgcctagactggagtgcagtggcccttcctaattgtttaatacaatttatgcgtataatctaattatagtaaggcaaggaagtgtaactttgaaatacatcagtagtaaaccacgcatcttgcgggtagtggacaaaccaagggaaggactgttcctcccacagagaggacattgtgggctaatcatatgcttatttacacctgctcttttttaaagcccccaagttcatgtggctaccatctgaactaactacccaaaaattttcactctgattcctattttgaataacatgcttatactcaccaataaatctttagttcaaatg

SEQ ID NO: 402170 - DNA, 439 bp, Homo sapiens
ggaatgaaggtcctcagtgacaggcgctgtgtgtcctcccaccatccgagatccaggcagacacgctgtggaatgaaggtcctcggtgacaggcgctgtgtgtcctccgaccatccgacatccaggcagacatgctgtggaatgaaggtcctcagtgacaggtgctctgtggcttacgaccatccgagatccaggcagacactctgtggaatgaaggtcctcggtgacaggcgctctgtggcctccatctcatcctacccttcagagcgcccgacctcacccctctggtagaagctcgcacatccagtggccagcccttcccttgctttctgggagaagcaccgtgacttgtagaaatgaccacaatatttttttaaatgaagttatgcaaatctgatagactgaagtaaatgtttcataaaatcaatgactgtttaaa

SEQ ID NO: 402171 - DNA, 468 bp, Homo sapiens
agaagaaaaatgaggagaatgctgtctcatggaagacaagctagcaaagcttggagaagcctgaacaagctggtcaccctcactgtcaaagactttcatttccacggaagggaaactgatgacctgggaccattggaagaactatatggatgaagcagttctaaggactgcaaagctgcgcagcgggaaccaactccctactgcagttatcattcgcctttaaagtctccgtgtcaagacacacagaaagtgtctacaccaaatggacaaacgttccagggggtttccttcccaactgcttattaagaaatccatcctcttcacatcagtgggacttcattctactcaaattccatcaattcccaatagctccaacacgaggacaaaccctaggagatgagggtgccatctcaagtctcttattttggttatttaactgaataagaaaatgtgtataactgcaaaaaa

SEQ ID NO: 402172 - DNA, 195 bp, Homo sapiens
tgcactactttgctccccctactttatcaattccagcctaatatttgtaccagtggcattgatgtagttcctttagcttttacctactgtggaattatagcagtttgaggaaaatcatattgagcctcatatctgtagataacaacatgaaacagataaattttggccttaaataatgttaacagagtttaagat

SEQ ID NO: 402173 - DNA, 455 bp, Homo sapiens
aaacatggtcatcccactctgagatgacaagagccactcctctagagacctgggggattttagaacagggctttcaaggtaatgaaggaagagaatcttctttggacttctttttgctccagatgcggagaaggcaacttcccggagtctctaccagtgagaaggctacagaatcatgggcagataaggtctcgctctgtggctatagctcactgcagcctcaaattcctgcgctcaagtaatcctcccacctcagcttcccaagtagatgggactacaggtatgtgccaccaagcccagctcctttctcaagctttaaaacaacaacgaaaacaaacaaacaaaggaaaaacctttgcattgtgtaatttagatttattttgtaaccatgttggattaagtataatttttatactgaggactcctctctttctttaaatcaggggaaaaaaaaa

SEQ ID NO: 402174 - DNA, 670 bp, Homo sapiens
aaacatggtcatcccactctgagatgacaagagccactcctctagagacctgggggattttagaacagggctttcaaggtaatgaaggaagagaatcttctttggacttctttttgctccagatgcggagaaggcaacttcccggagtctctaccagtgagaaggctacagaatcatgggcagataaggtctcgctctgtggctatagctcactgcagcctcaaattcctgcgctcaagtaatcctcccacctcagcttcccaagtagatgggactacagcgatggggtctcactatgttgcccaggctggtctcaaactacagtggctcaaacaatccttccagtactgcctcccaaagtgctgggattacaggcgtgagccaccaaactgcaattacttttgcaccaacctaataataccaacaagcagatgagcttggaaaacactgctgaactccagaaaggaaagtagctcagggcatacctagagtgtagtcttgcaagaccatgagcagaggatccagctaacacatgcctggactctagaccagtggacagtgagatagtaaagggttgtttctcaagccaccaaattgtggtaattgttgcacagcaatagaaatataatactataagctatcaggttagtttgagctctgagtacatatg

SEQ ID NO: 402175 - DNA, 391 bp, Homo sapiens
ccatcctgtctaaaactgcatccccaaacccttcctatcccttttctccacttttttctttttttaaactatagttcttatcaacatagtatatgttttgcttatttatcctgtttattgtctgactcaacaagtagaatttgaactttaaaaggcctatgatttttatctattttgatcaatgctttctatctaatgcctggaacaatgacacatagcagatactcagaaagtttttactgaatgaatatagtaactaagcagcctttagaaaagtcttggagaacactttcatctgagtagtgaggtcaaaggcggatatcaacgaggtgagacataaatgtgagggaaggaaacagaattacaaagtatagcctattttttaaacagc

SEQ ID NO: 402176 - DNA, 384 bp, Homo sapiens
atggggtctcaccatgttggctaggatggtctcgatctcttgaccttgtgtctgcccacctcggccaggatttgcattttatactccaataccatcttgtgctttatacctcctactatattgctggcctcatctcatttgctcacagtgtccccctgctggaatgtgctcctcaccacccgttcctcctctgagagatacagcccaggtgttgcctcctaagggaaaccttcttaaatctgggttagattggattgggggtccctcctctgtgctcccacagtatcttgtacctcatgagggtcagaatcctgtgccgtcatcatttacatatctcccctctcactaggacctgagttcttggagcactgagacctgctttaa

SEQ ID NO: 402177 - DNA, 413 bp, Homo sapiens
aacaggcatccttgaaagtttcatagtttacaataataaacattaatctcactctgcaggagcagggagaagtacaaccagtctccacttctggggtagtgaaggagaaaggcagtgatggggagtttccaggtgctgagattcaacccaatgcaacttgctacctggctaagccatctatgacttccacatcctgaagtcctcagactttccttttactcctctcccaaactcagtactcctggggcatttcccccagattgtgggagccaccagcagagacaagatctggggaaatactggtgtcagagcagcccagggaagggagaagcattcctgaaatcaaaggttgaaattctccttatacgttttccataaaaatgtggatgtttttggctcaaataagaataaca

SEQ ID NO: 402178 - DNA, 402 bp, Homo sapiens
ccttcaagacatgatgactgtttgtaatttatctttaaaagaatgccatagtaactggtgtgtacccctaattaatcataggaaggattgaccagacatcctttaacaattcttgctggactctctgctctttgggaaaaggttgaagagtatttattcaatgggagaaggacaccagctctctgtcctttaagtttatgtcttagctgttcacatatctggtggcaacaacttatgttgtctttgactgtgagaagagaaaatagcctagctctttttttttttttttttttttaatagaaacagtgtctcatgatgttccctaggctggtcttgaactcctgagctcaagccatcctcttgcctcagccttccaaagtgctgagattacaggtgtgagtc

SEQ ID NO: 402179 - DNA, 1890 bp, Homo sapiens
gtcattgtttgtaaactggaagtaacaactagctaccccatagggttatcctgagaattaaattgagctgatgctgatgaagccggtagcacagtgtaagtactcaataaatggtagctggtatggcattatcatttttcctctttaattcctctttgtgcttttaaaaatcttttaggctgctgtttcagagaaacaacaaactcacagtgctttttcccattctctcacttcacaacaacaatcaacatagaagacttctgtaaccaaatgtgtgggcgtttttcaccacatatcaagcagcagccaccagctgggtgtcctctaatttagtttcattttctgatgctgtcttcctggagatagcctcagatcccacaagatgtccctcctccccgcaaccagtcgataagtcagggcctctggaacttctgaccaaccagcttcaagttggggttctcatgaccccccgctttgggttcaattaatttgctacagcagctctcagaactaaaagaaacacatttaccagtttattatagaggatattacaaagaatatagatggggagatgtataggctgaggtacaggggaaggagcatggagttgccatgcccctcctgggtacaccaccctccaggaatgtccacatattcagcttattcaaaagttctccaaactctgtcctttaggaatatttatggagacttcattgggtaagatgattaattaagccattggcctttaggaagtagtgctgcaagtcccaaccttctaatcctgccttggcctttctggtgaccagcccccatcctgaaactacctggggggctatcagccatcagtcaatagtttgtcattagtatacaaaaagacattacttttgagattcctttgccaggaaacaggatgaagagcaaatacatatttcactgtatcacaggtgctaattttggtttagcaaatctctatagtcttcccttttttggggaaggagctgggtcaacctttgtggagtcaagatgaatcaaatacagtcccagcccctaagaagtattggatccagcagaggaggtgagatgaccacagccataatttaaggcagaaggtattagaaaattacaaaatacaatggaagagagaggtaacttctagtttgggaggttggaaagtactttctaaaaacatgcctggcatttaagggtgaagaggatttggacatatagaggcattaaaggaaggagcaaagaaatgggcagtgttcaggggcacttggctcacagtgagaagagggtatgtgttgggaaaggaatagttgctgaggctggaggggtaagttgagggcaagtcactaaaggcgctgagtgtcaggttgaagagttgggcctttatcctgtaagtaaagaaaggcaaatctcatttctagaactcttatgaacagttcatagtggctacttaaagtactgtattgaaaaggatacctagatgttatctgggcccagtggagaagactgttgtgcttgattaatggtgtgtgccaggggctcagtgggtgtgttagcaaccatgccacattatctatggataaaatatatataggagtagagaccgtataacccagggattaacatggtctgtggagctgggctgcttaaatcctggataagaagtgactgctgtggtctggctgcatggtcctgaggacctgaaccagggtcaggggcatgggagggaagagcctacacagtgaatgggctaaacctgggaacattttgaatgtgggactaagagaggagggctagattgctctacaatgctgcagaagtttctacctgcctggctgggaggtaggagggtctggtttggggatgtggccctgaggagaggac

SEQ ID NO: 402180 - DNA, 2977 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402181 - DNA, 1458 bp, Homo sapiens
gtcattgtttgtaaactggaagtaacaactagctaccccatagggttatcctgagaattaaattgagctgatgctgatgaagccggtagcacagtgtaagtactcaataaatggtagctggtatggcattatcatttttcctctttaattcctctttgtgcttttaaaaatcttttaggctgctgtttcagagaaacaacaaactcacagtgctttttcccattctctcacttcacaacaacaatcaacatagaagacttctgtaaccaaatgtgtgggcgtttttcaccacatatcaagcagcagccaccagctgggtgtcctctaatttagtttcattttctgatgctgtcttcctggagatagcctcagatcccacaagatgtccctcctccccgcaaccagtcgataagtcagggcctctggaacttctgaccaaccagcttcaagttggggttctcatgaccccccgctttgggttcaattaatttgctacagcagctctcagaactaaaagaaacacatttaccagtttattatagaggatattacaaagaatatagatggggagatgtataggctgaggtacaggggaaggagcatggagttgccatgcccctcctgggtacaccaccctccaggaatgtccacatattcagcttattcaaaagttctccaaactctgtcctttaggaatatttatggagacttcattgggtaagatgattaattaagccattggcctttaggaagtagtgctgcaagtcccaaccttctaatcctgccttggcctttctggtgaccagcccccatcctgaaactacctggggggctatcagccatcagtcaatagtttgtcattagtatacaaaaagacattacttttgagattcctttgccaggaaacaggatgaagagcaaatacatatttcactgtatcacaggtgctaattttggtttagcaaatctctatagtcttcccttttttggggaaggagctgggtcaacctttgtggagtcaagatgaatcaaatacagtcccagcccctaagaagtattggatccagcagaggaggtgagatgaccacagccataatttaaggcagaagccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402182 - DNA, 345 bp, Homo sapiens
gcacgaggtgcaaattaactgccctggtacttggctgtggctgttccggctgtggccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402183 - DNA, 895 bp, Homo sapiens
cgtggaggtcccgccccggaactgcagttgctgctgcagctgaggtacagcggcggtttctgaggttcttcactcgcgactgacggagctgcggtggcgtctccacacggtgagtaccaaaacgagcggggttggagccgactctggagaggggctgaggccaggaacccgggttcctatcgcgggtcgctctgggccggtgggttcccgggtccagagagggcggccgccggcccaagccgtccaaccgagctgcgtgccacggtccccgcgccttgggctccttgtccggtcatcagagcctgacggccttggcttctcggcttctcggtttctcggtttcgtgcgcgcgttcgtgcctgagacaaagcgagagggccgcgcgggaccggcgtcacgaggagacagaggcccttctactctgcctggcgctctccgtgtcctcgcccggttcgcgtggcacccctcgccctctccttgttgaaccccgcgtgtttctttgtttttttgtttgtttgttttttgtttttttgccgtggcgcagcgggtccggcgggcactgtgtgcgaacgtgctctcctcgccgggcgccatgctcagcggttttttttgacgtgcgtcactttttcgtagtggcgtataaggattctgtgggacagatgtcctcgtttttcccattgtgcagactgggaaataagagactcagagattaatacgtccaccgcagagccacagctgacaagtggtggatctggatttgaaccaaagtttaccttggtctttttcacggaatctgttatctttcttggcctttctgaaaaggaaaaacctggatcgagttccacccaaacgagttgggcctaaatggccattaagccacttaaaatatgatgaa

SEQ ID NO: 402184 - DNA, 648 bp, Homo sapiens
cgtggaggtcccgccccggaactgcagttgctgctgcagctgaggtacagcggcggtttctgaggttcttcactcgcgactgacggagctgcggtggcgtctccacacgatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaacctgggggggggccccggtccccatttggccttatagggggccggtttacaatccacgggcgggcgtttacaacggcggaccgggaaaaaccttggcgttccccaatttatcggcctggaaaacatcccccttgtgccagttggcgaataccgaaaaggccccaaccgtcgcctttccaacagtgggccaccttaaggggaatgggaaattgaagccttaaatttttgtaaaattcgcgtaaactttgggaaaggaatcgcccca

SEQ ID NO: 402185 - DNA, 3058 bp, Homo sapiens
  misc_feature (2986)..(2986): n is a, c, g, or t
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcagaaaaaaaaaaaatcggggctttnggggggaaggattgaaggcaggcattgttccgcccttggaaagggagcggcccaggggtatgatggaagaag

SEQ ID NO: 402186 - DNA, 2838 bp, Homo sapiens
cgtggaggtcccgccccggaactgcagttgctgctgcagctgaggtacagcggcggtttctgaggttcttcactcgcgactgacggagctgcggtggcgtctccacacgatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402187 - DNA, 2529 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaagagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402188 - DNA, 2923 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggacatgtataagggagggaaaagctgaccagcaagaagaacgtcggagacaaaagcagatgaaggttctgaagaaggagctgcgccacctgctgtcccagccactgtttacggagagccagaataagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402189 - DNA, 2861 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402190 - DNA, 2872 bp, Homo sapiens
  misc_feature (2800)..(2800): n is a, c, g, or t
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctcactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcagaaaaaaaaaaaatcggggctttnggggggaaggattgaaggcaggcattgttccgcccttggaaagggagcggcccaggggtatgatggaagaag

SEQ ID NO: 402191 - DNA, 2687 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggatgcttcctttgagaagagactggagggattcttggcaggggagaccaactggtaatctgtcaattcctcaaagcacaccaagtcatccatcctacaatgctctatttaaggccctctcccgctagactgcccggagagtggctgctgctgttttgctctgtctttcctgcacccagcacagtacttggaataaggtaggagctgaaatcatggagtgatgttgttgaacatcaacgacccctttatcacagaacattttaaatcaaggacagccacaggcctgtgtgtggagtgggcgggagccaggccaccttcctct

SEQ ID NO: 402192 - DNA, 1863 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagaggacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402193 - DNA, 1311 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaggttccaaggtcctggtggacggttggcccctgaaaggcggcggtacacttgtcgg

SEQ ID NO: 402194 - DNA, 1193 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgtgccctcgggcgcaagccgggaagggccctcccggccggggaacctttccccgggtgatgggggactttaaagcggggccccggggggcccc

SEQ ID NO: 402195 - DNA, 639 bp, Homo sapiens
cagcaaattaattataatgtaagttaagatttgctttttgccaagttgcaaagttctccacatctcctgaggagatgtggagaaggcatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402196 - DNA, 761 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaaaaaaaaaaaaaaaacaaaaaaaattttttggggggcttgggcttagagaaaagttttcgaaacacctctgcgcgttggggcccgccggccccaatgtgggcaaacgtcgaacaccggggccaataggtctgggtcccccaaaggaagaacccggggacaaggaccaagggggcgggatctcccacccaataaaaaaagcgccgggggggacacacccggcggtgttttggcacaattccgagaagggacgtcggaggggcaataacgggatcactcaacggggatgccaggaggcgaaataaatagcaggttgggg

SEQ ID NO: 402197 - DNA, 423 bp, Homo sapiens
cctcagtctgatgctcattgggcctgaggatgtgatcaactttaagaagatttacaaaacgctcaagaaagatgaggatatcccactgttccccgtgcagacaaaatacatggatgtggtcaaggtagaaagcagttaaaaccccagtgctaatgaagggattgtgctgctcccttgcagagcaccttgctgtgggactctggcagcataacccttgaaaactaaggaatggttctgccaacagctgaacaaggagacttgtagaaaggattgagagcaacatacctgggaaaagggagaaaaggggagtgactgaaggtgggaggcattttctccctgaaccatttcttccttctctggccctgaagtcccccctcctcaccagacagtgcagtggtcatggctgtctggatatcctgtcag

SEQ ID NO: 402198 - DNA, 2964 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402199 - DNA, 2660 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402200 - DNA, 2267 bp, Homo sapiens
gagtggaggagctttgggtcggtcagggtggcacttggctaccttattctatgcaaaagaatgaattccagactaaagtatgttcatctgttgattcacactgtttttactttgttttgtttttttacttttaaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402201 - DNA, 1979 bp, Homo sapiens
tacgcagtcacgaggcctcacgtgtaatcggccgagggtatcgagagtgttacatgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggagggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402202 - DNA, 2713 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggacatgtataagggagggaaaagctgaccagcaagaagaacgtcggagacaaaagcagatgaaggttctgaagaaggagctgcgccacctgctgtcccagccactgtttacggagagccagaaaaccaagtatcccactcacactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402203 - DNA, 2358 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccggcgaacacatactggtttgtgccagggcaaaccggtaactcgacaattggaaacggtatgtccggttgcgggaccctggttacacgcaccacctg

SEQ ID NO: 402204 - DNA, 1910 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagaaggaaggaaagaaggaaaggagggagggaaggagggaaggagggagctcgtgccgattctttggctcga

SEQ ID NO: 402205 - DNA, 1804 bp, Homo sapiens
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 402206 - DNA, 1289 bp, Homo sapiens
  misc_feature (1236)..(1236): n is a, c, g, or t
cgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggtnaaaggccctgtaggtttcaggtctctgtggcggtcgaccacagggcgccggcc

SEQ ID NO: 402207 - DNA, 559 bp, Homo sapiens
aactcatatatttgtcatctgattcaccaattttgaatgtcttgccacatttgcttttttccctctctccttcccttcttcccttctttccttccttccctccttccttttttcttttgttaaattatttgagaagttgtagatatcatgacatcttacccctgacagggttcaggattcgctaccccaaaatatggtgacctgttgtatttaatattttgggcttttattttgttttgttctgttttgagacagggtctcaccctgtcacccatgctagagtacagttttgttttgttttgagacaggttctcactctgtcacccatgctagagtacagtggcctgatagcagctcactgcagccttgaacttctgggctcaagtggtcctcctccctcagccttctgagtagttgggagtataggcatggtggcctccacctgtattcccagctgcttgagaggctgaggatggaggatggcttgagcctaggaggcagaggttgcagtgagccaaaattgcaccactgtactccagcctggaggactgggtttaaa

SEQ ID NO: 402208 - DNA, 166 bp, Homo sapiens
ctccctcagccttctgagtagttgggagtataggcatggtgtcaccatgctcagctaattttttttttaagtagatgtggggtctccctatgttgcacagggtggtcttgaatttctgacctcaagcaaccctcccacctcagcctcacaaagtattgggattacc

SEQ ID NO: 402209 - DNA, 477 bp, Homo sapiens
aaccaacaggtccctaatgattgcatcagctgaaaaatcaaccttctcaaaattaaaaattagcaaaaattacttatcttgcatttgccaagaatacatgttactttcaattatatattgaaaatgaagttgctaaaaatataaatttcgatgacttaataaatgaatttgcaaaaagagtgccagaaaatcttatgatcaatcaaggtatcatattaacaaactattagtaattattgtattatttaaagtttattacaacaaaactgttttttgtgatttgtaaatttatgttgttttatgttactattatacctattacattttacaagtagtaaaatatgttaaaggaaaaaagcataatttattttactttttactatacttctttttatacattctgagtaactgacctcacatttttattttgcactggccccatcaattatgtagtcatctctgccctgtattaaaatg

SEQ ID NO: 402210 - DNA, 619 bp, Homo sapiens
acagatcattctgtatttgcataaaatgacaaagatgatgcatgctcggtagaaagaaatcaggctgggaatggtggctcatgcctgtaatcacagcactttgggaggctgaggagggaggatcactggaagccaggagttcaaggccagcctgggtgacaaagtgagacacgcatctctgcaaaaaatttaaaaattagctgggcgtggtggtgtgtacctgtagtctcaattactaggaaggctgaggatcacttgaacccgagttcgaggctgcagtgaggtatgatggtgccactgccctccagcctgagtgatagagggagagcccatttcttaaaaaagagaggctgggtgtggtcgtcacgcctgtaatcccaacactttgagaggcccaggcgggtggatcacgaggtcaggagttcaagaccagcctggccaagatggtgaaaccccgtctctactaaaaatacaaaaattagctgggcatgttggtgggtgcctataatcccagctactcgggaggctgaggcaggagaattgcggtgaggaggaggttgtagtgagccgagattatgccactgcactccagcctgggcgacagagtgagattccgtct

SEQ ID NO: 402211 - DNA, 376 bp, Homo sapiens
aaaaattaaaattagctggatgtggtagcgtgtgtctgtggtcccagctactcaggaggctgaagtgggaggattgcttgagcccaggagatagaggctgcagtgagacatggtcatgccactgtgcctcagcctgggtgacaatgcaaaatcctgtctcaaaaaaagaaaaggagcatggacccaggctgggagataattgaggccatttttgcaaagagtctaccacattcccaaaggtccagtgcacaagaggggttcccagtcagccatttgacatgagagcatagctctaaattaacacttctctgaatcccacctgctgagctagctcatttctcacctctgatgctcccaaagacaacgagttcatttc

SEQ ID NO: 402212 - DNA, 583 bp, Homo sapiens
gccgggcagcgggagcggcggccgcgccatgtggctgctggggccgctgtgcctgctgctgagcagcgccgcggccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaac

SEQ ID NO: 402213 - DNA, 529 bp, Homo sapiens
actcctgtctagaattttaatttttaaccactgctgatggccagaaaagaacatttggattttacaaccagtctttgatggagaaagaaaaaaagtcagtgaacacccattttgtgcctgacattcaagtatgtttgttccctgtatttctccatttagtcctctcagaatctctggaggtggactggggcagattattaatctaccagaagtctcacctataccaaaccacacacctttcagttgaggggcgctgaggtccctgctgttgctgtgccatctgacctgtcccctctctctgacagagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccgtgagtggcctggccctttgctggggtggggtggcagccatcctggggcagaggggagcaggtcctgagcaggctta

SEQ ID NO: 402214 - DNA, 730 bp, Homo sapiens
gccgggcagcgggagcggcggccgcgccatgtggctgctggggccgctgtgcctgctgctgagcagcgccgcggagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaac

SEQ ID NO: 402215 - DNA, 729 bp, Homo sapiens
aactatgattctgagattctactactgagtagagtcatcactaagggctcatctctaagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcagtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgtaagtggtcttattttgcatgaagaatccctaaaatcttctctgaactgtgtccatgatgtaatgattcactgatttttattttattaaatgaagttgtgtcagcatttgaa

SEQ ID NO: 402216 - DNA, 3052 bp, Homo sapiens
aactatgattctgagattctactactgagtagagtcatcactaagggctcatctctaagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcagtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgacttcatccttctcactcctccacactccagccacttcctataatcccttaatgtgtcaagtatccacggccccaagatgatcagaggatcagcttcttccggctttgaaccgtcaccagttctgtttttcttgccttcggatgttactcaaaatagtgaacaacctgccccagaagaatatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaagaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatagacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaatgttaacactgtatcatcactttatgtatgtgaagaaataattcacatgtatattccttgtcat

SEQ ID NO: 402217 - DNA, 2601 bp, Homo sapiens
ggaagtctcagaggctggagagcagagcaccaagatcgttctggcaggaacagccagtgggaggttccagctgagcgctccccagaggtgagctgatccccagccacagcacacaggaccaggctgcgagaacagggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaatatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaagaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatagacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaatgttaacactgtatcatcactttatgtatgtgaagaaataattcacatgtatattccttgtcat

SEQ ID NO: 402218 - DNA, 2460 bp, Homo sapiens
caacccggctgcattaaatcctgcctcattgcagtgtaagttggacgaaaaggatataccattctcagctacagacatcaagacaagtactgccagatgccatcctttgaagaaatatgtgttttcagtagaactcttttcattgttctgtttttcttgccttcggatgttactcaaaatagtgaacaacctgccccagaagaatatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaagaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatagacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaatgttaacactgtatcatcactttatgtatgtgaagaaataattcacatgtatattccttgtcat

SEQ ID NO: 402219 - DNA, 2932 bp, Homo sapiens
aactatgattctgagattctactactgagtagagtcatcactaagggctcatctctaagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcagtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaatatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaagaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatagacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaatgttaacactgtatcatcactttatgtatgtgaagaaataattcacatgtatattccttgtcat

SEQ ID NO: 402220 - DNA, 763 bp, Homo sapiens
aactatgattctgagattctactactgagtagagtcatcactaagggctcatctctaagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcagtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgacttcatccttctcactcctccacactccagccacttcctataatcccttaatgtgtcaagtatccacggccccaagatgatcagaggatcagcttcttccggctttgaaccgtcaccaggccagttatacaattaactcatcctc

SEQ ID NO: 402221 - DNA, 3100 bp, Homo sapiens
aactatgattctgagattctactactgagtagagtcatcactaagggctcatctctaagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcagtgggctttggaactatatttgcacttaattacatcggtttctcccaaagacttccccttgttgtcctcacaggatatccattctggggagcacttattggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgacttcatccttctcactcctccacactccagccacttcctataatcccttaatgtgtcaagtatccacggccccaagatgatcagaggatcagcttcttccggctttgaaccgtcaccaggaattttgttaatcttactgatcatcagcatagcagagctcagcatctctgtgactattgcatcctttagaagcaagtgctggacacagtcagatgaggttctgtttttcttgccttcggatgttactcaaaatagtgaacaacctgccccagaagaatatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaagaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatagacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaatgttaacactgtatcatcactttatgtatgtgaagaaataattcacatgtatattccttgtcat

SEQ ID NO: 402222 - DNA, 3001 bp, Homo sapiens
aactatgattctgagattctactactgagtagagtcatcactaagggctcatctctaagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcagtgggctttggaactatatttgcacttaattacatcggtttctcccaaagacttccccttgttgtcctcacaggatatccattctggggagcacttattggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgacttcatccttctcactcctccacactccagccacttcctataatcccttaatgtgtcaagtatccacggccccaagatgatcagaggatcagcttcttccggctttgaaccgtcaccagttctgtttttcttgccttcggatgttactcaaaatagtgaacaacctgccccagaagaatatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaagaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatagacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaatgttaacactgtatcatcactttatgtatgtgaagaaataattcacatgtatattccttgtcat

SEQ ID NO: 402223 - DNA, 2866 bp, Homo sapiens
aactatgattctgagattctactactgagtagagtcatcactaagggctcatctctaagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcagtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaatatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaagaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatagacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaacca

SEQ ID NO: 402224 - DNA, 1889 bp, Homo sapiens
  misc_feature (1889)..(1889): n is a, c, g, or t
tttatggagtttacattccaatggagaagacagacaataacatatatcaaatgctataaagaaagggcagggaatagggatacaatgtgttgaattttgtcaaatgctttttttgtatcttttgagattatcatatggcttttgtccttcattctgttaacatgatatatcacatttactgatttgtgtatactgaatcatctttgcatcccgggatgaatcccactgggacagaatgtggagagggttgaaactttagataagatggtttgggaaagcctgtttgaagagatgacatatgcagaggccccagtgaagtaagcatatgagtcatataaatatttggggaaagagcattctggacaaaggtaaaaaacaagtgaaaaggccctaaaatgttaacttacttggcatgtttgaggaataacaaagaggccagtaaggttacagcatagtgattaagagagaagaatggtaagaagtgacataaggaagaaagccaggtccttatagcctggcatggatatgtaaatgggaagcaattagattgagaagaggagtgacataatttgatttacctttatgaaatatggagctacaatgtcaaggttagactgaagaagattaaagaggaaagcagagactggttaggttattatagtgtcctaggtaacagttttggacaagtgtgataaatgttgaggtgggaggggttagaggttggattcagactctgttttgtaagtagagaagataatgtctgctgatagcttggatatgaggaggaaaaggagaggagtaaaggatgactcagatttttgacctgtcaattgggtgaactctgagattaaattctgttttggctatgttaggttggaaatgctgtgtaggcaattggatatccaagtctggacttcagagtacaatttgggactagaaaattaatttgggagtcattagggaataaccatgactttggatgagatcacctagtacagctagagaagagaaggtagcaaaagacagagacctaaggtatgccagcattgagaagtagaggagaagaggaaccagcaaaagactgagaaggacccaccagtgacctagaagaaaaatcaggaggctggtattctggaagccatcagaagaaaatgtttcacaaaaggaaggtagtattgaatggtgtgaaatgttacctatatacctggaaaaaagcaacttcagctgctttttaagtaaatgtgatagtttgtactgcaaataactttccatattgcttttcagatcatgatattttggtccttaagatcatgtagaactttccattgtgagaagggagttgattattttatcattaaagaaacttttctaaacttaaatttatgaaaaataaaaaaaaaacaaaaaaaaagaacaaaaaaaaacacaaaaaaacaaaaaaaaaaaaaaaaaaaaaaagaaaaacaaaaaaaaaaacaaacaagcaaaaaaaaagagggaggggggggcggaccaaaaaaacacccgccgcggagcggccaccacacaagagacacccacacgcgcttttttgataaaacgggggccccccaacaaggggcagcgtcaaacaaaacaggagcgaccgggggctttaaaaacaaacagcggtcgccggcgaaaaactgactgctatcgagtgatgcatcatgtaggagaaagacaccaacaccatcggggggggaggaacacaaaactggggaacacacccacaaaaaaggatagaagcgccgcgtagggaaaaaaacaagacagcgagagaggggctgaagacaccacatcatgatgcggctgcaggagatgtgcagtgagttaattaataatatttacccggcgttatctaataatgn

SEQ ID NO: 402225 - DNA, 1393 bp, Homo sapiens
tttatggagtttacattccaatggagaagacagacaataacatatatcaaatgctataaagaaagggcagggaatagggatacaatgtgttgaattttgtcaaatgctttttttgtatcttttgagattatcatatggcttttgtccttcattctgttaacatgatatatcacatttactgatttgtgtatactgaatcatctttgcatcccgggatgaatcccactgggacagaatgtggagagggttgaaactttagataagatggtttgggaaagcctgtttgaagagatgacatatgcagaggccccagtgaagtaagcatatgagtcatataaatatttggggaaagagcattctggacaaaggtaaaaaacaagtgaaaaggccctaaaatgttaacttacttggcatgtttgaggaataacaaagaggccagtaaggttacagcatagtgattaagagagaagaatggtaagaagtgacataaggaagaaagccaggtccttatagcctggcatggatatgtaaatgggaagcaattagattgagaagaggagtgacataatttgatttacctttatgaaatatggagctacaatgtcaaggttagactgaagaagattaaagaggaaagcagagactggttaggttattatagtgtcctaggtaacagttttggacaagtgtgataaatgttgaggtgggaggggttagaggttggattcagactctgttttgtaagtagagaagataatgtctgctgatagcttggatatgaggaggaaaaggagaggagtaaaggatgactcagatttttgacctgtcaattgggtgaactctgagattaaattctgttttggctatgttaggttggaaatgctgtgtaggcaattggatatccaagtctggacttcagagtacaatttgggactagaaaattaatttgggagtcattagggaataaccatgactttggatgagatcacctagtacagctagagaagagaaggtagcaaaagacagagacctaaggtatgccagcattgagaagtagaggagaagaggaaccagcaaaagactgagaaggacccaccagtgacctagaagaaaaatcaggaggctggtattctggaagccatcagaagaaaatgtttcacaaaaggaaggtagtattgaatggtgtgaaatgttacctatatacctggaaaaaagcaacttcagctgctttttaagtaaatgtgatagtttgtactgcaaataactttccatattgcttttcagatcatgatattttggtccttaagatcatgtagaactttccattgtgagaagggagttgattattttatcattaaagaaacttttctaaacttaaatttatgaaaaataa

SEQ ID NO: 402226 - DNA, 416 bp, Homo sapiens
aggaaccagcaaaagactgagaaggacccaccagtgacctagaagaaaaatcaggaggctggtattctggaagccatcagaagaaaatgtttcacaaaaggaaggtagtattgaatggtgtgaaatgttacctatatacctggaaaaaagcaacttcagctgctttttaagtaaatgtgatagtttgtactgcaaataactttccatattgcttttcagatcatgatattttggtccttaagatcatgtagaactttccattgtgagaagggagttgattattttatcattaaagaaacttttctaaacttaaatttatgaaaaataatttttcccttaggtttgtctttttgttcaataatgattccctgggtatctttttttgccccacaaataaaatacttagacatacctgg

SEQ ID NO: 402227 - DNA, 464 bp, Homo sapiens
tcagcttaggcagcagtgccatgacatggcaggaagactggcctagagggagaagaccctggaagaagcctgtctctgtcacttcttagaaacgcccactgttgcttagcctctgcagatgggaaatggatgcgaaatggccttacttctcatgagatgacactggcaccactgtgagcctgagtgcctccttaacttttgtgcctgaggtgcctctctagtctcaccctggtcctggcgctgctggggataagtagagggagtggagtcttggatgaactagaggcatgttgcacacagccggagagggagaaaccgaggagagaaaagagaagagaaagtgagtgggatggaacagcctgcaggagtctggatggaaggggtctttggtttaggttggtctgcttttgaggcaaagacacacattcccagagatttgaaggaagcctgcataaaacagagac

SEQ ID NO: 402228 - DNA, 393 bp, Homo sapiens
gctccaacagagcagaggggacagcatatggctgtgtgtcacgtccagaatgcagacttggagctttgtggtgttcaggatgaagtcacacactgtccagctttcagctacatcatgtcagaatatgaacgaataaacaatctcttgtgcttccctggttgatctggccttgtctggctcatgtgctgttaaacaccatcggcccttataaacagaaatacaacatgctctacataaagacatcacatctaaattagccagaggcagtggcatgcacctgtactcccagctactcttgaggctgaggcgggaggatcattcgagcccaaaaatttgatgctgcagtgagctatgcttgactgagacctgcctgtcaaaaaaagaaaaaaaaga

SEQ ID NO: 402229 - DNA, 230 bp, Homo sapiens
tcagggtttcccagaggaagagagagaatttggacaaatgaatgaggaacaacgctctcctgagggttttctttaaggggcgaggatcactgccgctagctcctttgaaagcaaagttaagaggcagcgcaggaaggcacagcaggaaggctcatggttagactacagagaaggaagcagccactgctggggacctaccctgtgctggtcactgacaagctgtctcatta

SEQ ID NO: 402230 - DNA, 240 bp, Homo sapiens
atacagatgtaaaagttatttaaaatttattagcaaattaagtccaaaatgcataaaaagaataggttttgataaattggcatcatcgacaggaatacaaggttgatttaacacttgaaaatcattgtaatatactgcattaagactcagaatcatataatcatcttagtatttacaaaatttaaaagttttgacaaaattcaacaaccatttaaactgtcaacaaatagaatcatataa

SEQ ID NO: 402231 - DNA, 344 bp, Homo sapiens
ttggaaattaagccaggctcctctagtaaaggagagctggaagttggaagtacagtagaagtcagagtgtcttatgttgaaaaccctggctatttctggtgtcagctgaccaggaacatacaaggacttaaaactctaatgtctgatattcagtactattgcaaaaatacagctgctcctcaccagagaaacacccttgcttgtttggctaagcgaacagtaaacagacagtggtccagagcacttattagtgggatacagtctgtggagcatgtcaatgtaacatttgtagattatggagacagagaaatggtatctgtgaagaatatttattcaattagtga

SEQ ID NO: 402232 - DNA, 390 bp, Homo sapiens
attgtgccactgcactccagcctcggtggcagtgagaacctgttttcaaaaaaaaaaaaaagtatatccccttcaatgcagaaattttatttctagaactgctatggaaatatacaagcaggcaaatatatgtctggatgaggaggctgtagccattatggcatagaaaactcaaagaggcctaaatgtttattaacagtggattggttatacatatcttggcatatcaccacaacaagctgctgtgcagttgtttaaaaaaagaatgaggcatttataagagggaagaaagatctatttaaacaaaaaccaaacagatataaactcaagaggcgggcagatcacaaggtcaggagttcgagaccagcctggccaacatagtgaaactcc

SEQ ID NO: 402233 - DNA, 393 bp, Homo sapiens
ctgggagggtgggagtcgccagcacaaagccggagcccaggccggcctggcttttctttgtcttttaaacctggttttgattagggacaagagagcgttattacaccattagagagcaattaaagatagaaaaagccctcacctcggcccatcccaacaccaccgctctctccatctgctggggctctcttctgaccccgtcccagcagcatccatgcaaccgcaggcacaatgcacgtgccttttcgtactctgcttttccaccctatggtctgtcccgattgctgctccatgtcgcccctgttttgtatttaagtttctattttagaatgtcacggtgctgagaaaattgacattctaccctaatagttctgccttatgctggaaatcctc

SEQ ID NO: 402234 - DNA, 790 bp, Homo sapiens
agcatgcgcccgagggtgtttcggggcgtccgaagcgggcgtgctccagcctgctcagcagcgagtggttggaaattagcaaagtgagagggtgaaaggaagcaggaggaggagggagttctagcgaagacttcggagggaagcaacccatcccctgccacaagaaagcaccgccactccagtgggaacggacacgcgtgcacacagccacgagtgagagaatacagcagttccaaggacaagggattcgtaccactgctcctcactcagtaaatagcagagacagaatttgaacgtctcactctgtcacctgagctggagtgcagtggtgcgatcacagcttactgcagcattgaactcctgggctcaagtgatcctcttgcctcaggctcccaagtagctgtgactgcagtgtccttgctggccttgcaaaatgagttcggaagggtcgattccatcctcttcagttgtggaaagagtttaagaagggctggtgttaattcttctctttacaatattcgatgaaattcaccagtgaagccgtgacatcctgggatactcttggtgagaggttgaatgcctttgagaacttgatgccgtaaaatttgcatgactctccatcctttctggatctctcattggactcaagccagcatggctcacagcacaaaggttaacggcagttgcctcaggaaaagccggtgatattctcagtggacgacacaggaccagggaaccgcaaagacccgtaactttgtggaagaacccactatggttattcaactagaac

SEQ ID NO: 402235 - DNA, 159 bp, Homo sapiens
agcatgcgcccgagggtgtttcggggcgtccgaagcgggcgtgctccagcctgctcagcagcgagtggttggaaattagcaaagtgagagggtgcgtggcctgagggactcggggaggctgagggctttttttctcaacactgtgaagctcagggaaag

SEQ ID NO: 402236 - DNA, 642 bp, Homo sapiens
agcatgcgcccgagggtgtttcggggcgtccgaagcgggcgtgctccagcctgctcagcagcgagtggttggaaattagcaaagtgagagggtgaaaggaagcaggaggaggagggagttctagcgaagacttcggagggaagcaacccatcccctgccacaagaaagcaccgccactccagtgggaacggacacgcgtgcacacagccacgagtatggtgatgacactcccaagtccatgtgggactccctccttatgcgggcctcagtctgtcatcttccttggagcaggaccaaagtaaataagataaagtcacaatttctcatccttcttcactcaacttttctttgaggagagaatacagcagttccaaggacaagggattcgtaccactgctcctcactcagtaaatagcagagacagaatttgaacgctagctgtgtggcctcacctaacttctctgaaccattgctcacatgtaaaacacggaaaaaattatccacttctcagggatgttgtgaagattaaaagaacaagagatgtagagtgctcagcacagtgcctctgctctgggaagcactccagatgtgtctgcttttgttgtgattttgccattcttcaacaaagttaaaagagcctca

SEQ ID NO: 402237 - DNA, 749 bp, Homo sapiens
agcatgcgcccgagggtgtttcggggcgtccgaagcgggcgtgctccagcctgctcagcagcgagtggttggaaattagcaaagtgagagggtgaaaggaagcaggaggaggagggagttctagcgaagacttcggagggaagcaacccatcccctgccacaagaaagcaccgccactccagtgggaacggacacgcgtgcacacagccacgagtatggtgatgacactcccaagtccatgtgggactccctccttatgcgggcctcagtctgtcatcttccttggagcaggaccaaagtaaataagataaagtcacaatttctcatccttcttcactcaacttttctttgaggagagaatacagcagttccaaggacaagggattcgtaccactgctcctcactcagtaaatagcagagacagaatttgaacgaatgctacgctggtaagggaagaaagcctcaagaaagcatctgtaccattccagcaaatacactgtgcatgctcccctcccaaatgctagcaggccactgcacatatggacagcccaccccaagggaagaattgggagaagtaacccaagaccccgaaagtatgccaacctgtaagaccgcaagtcaaaggtcaaactgtgcacttgatctcacaaggtgcccactcggccctcttccaaatatactctacttcctttcattcctgctctgaagctttttaataaattttcactcctgcttgaggactaagctct

SEQ ID NO: 402238 - DNA, 577 bp, Homo sapiens
agcatgcgcccgagggtgtttcggggcgtccgaagcgggcgtgctccagcctgctcagcagcgagtggttggaaattagcaaagtgagagggtgaaaggaagcaggaggaggagggagttctagcgaagacttcggagggaagcaacccatcccctgccacaagaaagcaccgccactccagtgggaacggacacgcgtgcacacagccacgagtatggtgatgacactcccaagtccatgtgggactccctccttatgcgggcctcagtctgtcatcttccttggagcaggaccaaagtaaataagataaagtcacaatttctcatccttcttcactcaacttttctttgaggagagaatacagcagttccaaggacaagggattcgtaccactgctcctcactcagtaaatagcagagacagaatttgaaccactttaccgtctttcctgcccagctgttgaaatatcaaactgtaccaagattttggccatgatggactctgttctctgcacactaagagatttatcttcctgatcatcagtagaaatattaataaataatattggttgccatt

SEQ ID NO: 402239 - DNA, 762 bp, Homo sapiens
gcctgagggactcggggaggctgagggctttttttctcaacactgtgaagctcagggaaaggagtagaactgggaaccaagtaaagtaaaatcgtggcaagtgggcatagacctgaaatctccttcgtgagggaacccagaacgtgcagctcaatgtatgtttggaacgaacaggtgaaaggaagcaggaggaggagggagttctagcgaagacttcggagggaagcaacccatcccctgccacaagaaagcaccgccactccagtgggaacggacacgcgtgcacacagccacgagtgaggtttgaaagaggccccaccctccattacacctgtgctccaccgtggcccccagccaagtttaatctcccattcagcacttacttctggaagcttctttccctttccttcccaccactcattggcctttcaccccctagttttttgtctgtgtgtgggactgtcttcccccactccccttgactgaagttccttgagagcagcagccctctttttatcagggaagagatttgaagctcaggacattcttatccaagtaggtgctagccacctgggtagtcaagacagggccctgcacagttaatgtgaatcttgtcataatgccagggttattgttttgcaaggagccggtcatagaacactagattgcattgtcactgggaaataagctcattctattagcttgtttctcagctagcttatgtagaaatttgccacagttgttactgctgggcacctgccc

SEQ ID NO: 402240 - DNA, 359 bp, Homo sapiens
acatagatgtttatagcagctttattcataatttatccaaaacttggaaacaagatgtctttcagtaggtaagtggataactgtggtacttctgaataatggaatgttatttagagttaaaaagaaatgcattcactttgggaggccgaagtgggtggattgcttgaggccaggagtttgagaccagcctggtcaacatgggaaaaccccaattagccgggcatagtggcgtgagcctgtaatcccagctactcgggaggctgagatatgagaatcgtttgaacctgggagatggaggttgcagtgagccagtgccactgcacttcagcctgggcaacagagcaagactcctctgtctc

SEQ ID NO: 402241 - DNA, 361 bp, Homo sapiens
tttttttttgagatggagtctcgctctgttgccctggctggagtgcagtggtgcgatctcagctcactgcaagctccgcctcctgggttcacaccattctcccgcctcagcctcctgagcagctgggattacaggcacctgccaccacgcccagctaattttttgtatttctttttagtagcgacggggtttcaccacgttagccaggattgtctcgatctcctgacctcatgatccgcccacctctgcctcccaaagtacaggcgttagccaccgcgcccagccaaaaaacattcttaggatgatttttctctttgtgtaaccctcagaagtagacataagaggcctttatcagggaagc

SEQ ID NO: 402242 - DNA, 438 bp, Homo sapiens
gttccgagaacacctgtatttggtgtaaaaatgggtggcaccacagttcaagaaatcttcacctttttccagaaatcttcatgaatattccactccctggtaaaaaaaaaacaaaaaacaaaaaacaaaacccataaataaagaggccagatgcagtggttcatgtctataatcccagtactttgggaggccaaggtgggtggatcgcttgatccctggcggtcgaggctgcattgagccgtgatcgctccactgcaatccagcctaggcaacagaaagagaccctgtctcaaaacaaacaaacaaaacagaaaaacaaaaacccataaggatagaaacctcaaaccccatagcatgacattcttgagtatgctcacactcccctttcttgagtgcgtacttctcgatttgcaataaatctctgtactttcactattt

SEQ ID NO: 402243 - DNA, 482 bp, Homo sapiens
agaatccccaaaaggagagcaaggcttggctaacaaaaacaggcatccactgtgtggttatgtctattctatagattttgtagatgaggtttaaaagcatggccccaagtaaaggtggcatctctatcctatcctcgcctttatctaaactctgtgaccgatcaatagcatatgatggtggtggtgctctgccagtctcccagtcccagactgaagcactagcagcttccacttattatctcttgggactctagctcttgggacccaaccaccatgctgtgaagcagcccaggccacacagagaggccacgtgtacatgttcagctgacagcagtatcaaatgtcagacatgagagaggaaggcttcaagatgactccagcccagccaccgtctgagaacaaagtaagaactgcctcactgatgccattcaaagcccagcaccatgagagataataaaacgttgtttgaagatgctaacttt

SEQ ID NO: 402244 - DNA, 623 bp, Homo sapiens
agctggaacacagccaggacacagacgcggatgatggggccttgcagtaagcagcctgacaggagcaatggccaccagcaggtgaagggcatcgctgccccaggcctcaagccgggcccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402245 - DNA, 1167 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggtgagcaggggaggggcgtgcccaggcatgaaacagccaagctggaagggtcttgagagattgttggtgcagcccactgagttctccaaatgagaaccaaaacccagaggtttgcctggggttgctccaccagtcggtagcagagctgagactggggtcctgtgctgcaggtgctcaggccagagctcctaccaccatacaacactgtctgc

SEQ ID NO: 402246 - DNA, 336 bp, Homo sapiens
  misc_feature (264)..(264): n is a, c, g, or t
  misc_feature (311)..(312): n is a, c, g, or t
cggaatacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcccggcaccagccccccaagagacacaacttctgagcagcctgcccagggggaagcacggacccgagacgacngcgatgaggaaggctcctgacacacagcgaggaagagctgaacacannagacacaaccgcgctggtgtatta

SEQ ID NO: 402247 - DNA, 536 bp, Homo sapiens
taaagtgtgtttttaaccgaattctttcatgctgtgcccttgggtggacactgaatgtggatagccatcctcatttggcatatggggaaactgaggctcaggtaggctcagttgacccccactcccatacctctctattcctagctggggatttgtgctgctttgagatttgcaaactctgagcagaggttggggtggcagttgaccaagcagaagccaggtcatgtaatagagcaggcctgggtgccaggggacctagggatgtctcctcttttgaatggggtataactgctaccacctgatgccttgcctgcccttactgggcctggatggttggagaggttgtagtgaggtagtgaggatcccaacagccatcagggtccggcaagcccttcctcttcactccagggcttgctaggagccagcagaggtgtgtagtgcaggcctcccagcccctcaccagcttgggttttttctataggtttggcggggggccacagggaggggaccctgacaataaagagattggatcccaa

SEQ ID NO: 402248 - DNA, 361 bp, Homo sapiens
ctgaatctagaacttggggaggtgtctggagatgagggcctgtggaaagtgggctgagtggccgtccctaagctccagccctctcccctttgtttccccagtggctacatctttgactatgattactaccgggacgacttctacgacaggtgagcaggggaggggcgtgcccaggcatgaaacagccaagctggaagggtcttgagagattgttggtgcagcccactgagttctccaaatgagaaccaaaacccagaggtttgcctggggttgctccaccagtcggtagcagagctgagactggggtcctgtgctgcaggtgctcaggccagagctcctaccaccatacaacactgtctgc

SEQ ID NO: 402249 - DNA, 402 bp, Homo sapiens
ccaacttaaagaagtgtccctaccaagatagaagagcaaagaggaaagagtcccccactgcaaggagtactgcaataatacagggaagtagctacatttcatcttcattctagaaatagggagacttggcaaaaggacagacaaaactctagacactataaatttggttctggaagggattaccatccatttattgcattttttcaagcatcaagttccctagaatattaattgccttttaaccattattcatcaagacagactgaagatggcaaggatcctgatatcaccagaagacagcctcacaagtgccttcttatcccctgaaaaaccttatggtctacagctaaacagtttggttgtagccttgtaaaggataataaacatccaggaatcataaac

SEQ ID NO: 402250 - DNA, 1810 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402251 - DNA, 1775 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402252 - DNA, 2002 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaaaaaaaaaaaaaaaaaaaaaaactccggggactaagtgaggggggggaaaaggggtctggatggcactgggcatactgtttccggaccagtttttgtcaaggtgaatgtgggacccaaaaggagggataatcataagcgtacgct

SEQ ID NO: 402253 - DNA, 1769 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402254 - DNA, 1173 bp, Homo sapiens
caaggcatagcccttgtgcacagaacagccggcacacggcatacttagagaagatggtctccaatgagcgccatgcccggccagcacccgcccattctctcccagcacagctgcccgggcatggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402255 - DNA, 1408 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggctccagcggcggtgtttgttgtttatgtttcttcttttgctttgtttttgatattggtcttttttcttagggttcctactactgtatttttatcctcgatatatagtatgatattataaaatatagttctattaaattctatat

SEQ ID NO: 402256 - DNA, 1787 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402257 - DNA, 1450 bp, Homo sapiens
taaagtgtgtttttaaccgaattctttcatgctgtgcccttgggtggacactgaatgtggatagccatcctcatttggcatatggggaaactgaggctcaggtaggctcagttgacccccactcccatacctctctattcctagctggggatttgtgctgctttgagatttgcaaactctgagcagaggttggggtggcagttgaccaagcagaagccaggtcatgtaatagagcaggcctgggtgccaggggacctagggatgtctcctcttttgaatggggtataactgctaccacctgatgccttgcctgcccttactgggcctggatggttggagaggttgtagtgaggtagtgaggatcccaacagccatcagggtccggcaagcccttcctcttcactccagggcttgctaggagccagcagaggtgtgtagtgcaggcctcccagcccctcaccagccacacacgtttgtagccggagctgcaataccgccctggtggccacaagccatgctgcagcctctggcccatctgccctcacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402258 - DNA, 1734 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagctcttgggacccaaccaccatgctgtgaagcagcccaggccacacagagaggccacgtgtacatgttcagctgacagcagtatcaaatgtcagacatgagagaggaaggcttcaagatgactccagcccagccaccgtctgagaacaaagtaagaactgcctcactgatgccattcaaagcccagcaccatgagagataataaaacgttgtttgaagatgctaacttt

SEQ ID NO: 402259 - DNA, 1565 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacgaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402260 - DNA, 1899 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggtgagggcctggccaggggcacgactgggactcgactgtgctcctactctcaggaggccaacaggggaatgggcagcctgagctggttgcccccactgtgaacttcctgttctctccttcccaggggttctggtcctgggggaaagagggaagaatgagcagggggcacttgcctatctcagacaccatcagaagtcccactgaggcctagggcagacctcccccaaatgcgggcacattctggcctccggtttccacatgagttggagaatgggagattcggacataagggagcacacacggcctgcagagcttcagagcagggctggggtggcttgtggaggccacagccaggaggtgggtttttctaaaagccattgctgcttaagcatgaagcaaaagctgtctcataagggggtgagctccccgcctgttactagaa

SEQ ID NO: 402261 - DNA, 1399 bp, Homo sapiens
  misc_feature (1361)..(1361): n is a, c, g, or t
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtgtggtgcggggggggggcagcggcacaccccagagacacatctgagaggctccngggaacacggccgaagacggaaggaaggcgccagggaa

SEQ ID NO: 402262 - DNA, 1108 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagctacatctttgactatgattactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402263 - DNA, 1071 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagctacatctttgactatgattactcctgccatcatgacccttggccataatatgattatctccacactagcagagaccaaccgaacccccttcgacctgccgaaggggagtccgaactagtcatcaggcttgaacatcgaaacgccgagataaatcgggccgagc

SEQ ID NO: 402264 - DNA, 1316 bp, Homo sapiens
  misc_feature (1278)..(1278): n is a, c, g, or t
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtgtggtgcggggggggggcagcggcacaccccagagacacatctgagaggctccngggaacacggccgaagacggaaggaaggcgccagggaa

SEQ ID NO: 402265 - DNA, 1154 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactgtcttcatttccctatttgtaaagttggagtgcctccctgtcccctcacgtctcatgtgtgtactcctaccatgcaggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402266 - DNA, 973 bp, Homo sapiens
taaagtgtgtttttaaccgaattctttcatgctgtgcccttgggtggacactgaatgtggatagccatcctcatttggcatatggggaaactgaggctcaggtaggctcagttgacccccactcccatacctctctattcctagctggggatttgtgctgctttgagatttgcaaactctgagcagaggttggggtggcagttgaccaagcagaagccaggtcatgtaatagagcaggcctgggtgccaggggacctagggatgtctcctcttttgaatggggtataactgctaccacctgatgccttgcctgcccttactgggcctggatggttggagaggttgtagtgaggtagtgaggatcccaacagccatcagggtccggcaagcccttcctcttcactccagggcttgctaggagccagcagaggtgtgtagtgcaggcctcccagcccctcaccagccacacacgtttgtagccggagctgcaataccgccctggtggccacaagccatgctgcagcctctggcccatctgccctcacaggctcttcgactaccggggccgtctgtcgcccgtgccagtgcccagggcggtccctgtgaagcgaccccgggtcacagtccctttggtccggcgtgtcaaaactaacgtacctgtcaagctcaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402267 - DNA, 988 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagctacatctttgactatgattactcctgccatcatgacccttggccataatatgattatctccacactagcagagaccaaccgaacccccttcgacctgccgaaggggagtccgaactagtcatcaggcttgaacatcgaaacgccgagataaatcgggccgagc

SEQ ID NO: 402268 - DNA, 683 bp, Homo sapiens
atttgcatgtgggtagttgtctatactgagtgtacttgagaatacacgttacctgtgtgtgagtttcttacctggatatgtgaatgtatgtgtgagtgtggctctgtgtatgcgttcccatgtacctgatgtgttacgcatttacatgagtgtatttgagaatgcatataggaatattcgacgtgtgtgtgtggtggggcgggggggaggacatgtttatgagcatgcctggatggatctgaaagtgtatggacatataaacaggcatatccatgtgatacctggatatgaatctaatgtttgaagattagatgtatgaagacctttgttggcaccatcagtgagcagaatccatgtgtataccgtgtaagcacatgaattgctgtgcgtgtgcatgaggttgatgtgtgtgggcacactgtcatgttagcattccaactctgccttctccctccacacagacatcaacatggctggagagcctaagcctgacagacccaaggggctaaagagagcagcatctgccatatacaggtggggctgtctgactgtctgtctgtctggtgggatgactctctctttccacagagggagtaaatgctggtgtgacagtgtgctgaatctagaacttggggaggtgtctggagatgagggcctgtggaaagtgggctgagtggccgtcc

SEQ ID NO: 402269 - DNA, 1858 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402270 - DNA, 1817 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacagccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402271 - DNA, 1752 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcgccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402272 - DNA, 1975 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggttcccagagagggggcttcttgaaaagcaagtagagcagaagactggtgagcacggtgtttcccagcatctccacagtgccagcacagaggaggacactcaagaaatgtttgttaagtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402273 - DNA, 1391 bp, Homo sapiens
gcaactttcattccctctgaaataaaacagtgcttaggccagtacctagtctgtttccaactgtgcggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402274 - DNA, 1465 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccttccgccaggccgtttccaccgaggaaaaggaatcgtatcgtatgtccgctatccagaactccactctttcgaacccttgctgatgcagtaagggtgatgacttgattctgctgccactgaggattatattcctatagaattcaacagagaacgggggaaacctaatactgtccaggattcgctgagattacaataa

SEQ ID NO: 402275 - DNA, 1651 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagacagactgaagatggcaaggatcctgatatcaccagaagacagcctcacaagtgccttcttatcccctgaaaaaccttatggtctacagctaaacagtttggttgtagccttgtaaaggataataaacatccaggaatcataaac

SEQ ID NO: 402276 - DNA, 1569 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccagcggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgagcgcacaggggggctcccttggaacacaacaagccgcaggcaagagctggaacaacaggcccagggaacacacaaggaacgccggggacatcgcaatcggcgcgcccttcggcagaacagcaagcctgacaggagcccaacggggc

SEQ ID NO: 402277 - DNA, 1333 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctcaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402278 - DNA, 1078 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402279 - DNA, 921 bp, Homo sapiens
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactgcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402280 - DNA, 955 bp, Homo sapiens
  misc_feature (779)..(779): n is a, c, g, or t
  misc_feature (782)..(782): n is a, c, g, or t
  misc_feature (789)..(790): n is a, c, g, or t
  misc_feature (798)..(798): n is a, c, g, or t
  misc_feature (809)..(809): n is a, c, g, or t
  misc_feature (812)..(812): n is a, c, g, or t
  misc_feature (826)..(828): n is a, c, g, or t
  misc_feature (837)..(837): n is a, c, g, or t
  misc_feature (847)..(848): n is a, c, g, or t
  misc_feature (867)..(867): n is a, c, g, or t
  misc_feature (871)..(871): n is a, c, g, or t
  misc_feature (873)..(873): n is a, c, g, or t
  misc_feature (876)..(876): n is a, c, g, or t
  misc_feature (878)..(878): n is a, c, g, or t
  misc_feature (884)..(884): n is a, c, g, or t
  misc_feature (893)..(893): n is a, c, g, or t
  misc_feature (895)..(895): n is a, c, g, or t
  misc_feature (915)..(915): n is a, c, g, or t
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgaggtcacnccnatccccnncacgtgtngtctcacacantcnctccgtcgtctccnnnataccgtcnacataacatnngtcacaccgtaaccgtcanacancnaancncgtaanacaccaccntntcccatatacagtccgtacntgtgtcagtatcagtacgtacgcccatcagttgtaacaca

SEQ ID NO: 402281 - DNA, 375 bp, Homo sapiens
  misc_feature (11)..(11): n is a, c, g, or t
  misc_feature (63)..(63): n is a, c, g, or t
  misc_feature (70)..(71): n is a, c, g, or t
  misc_feature (74)..(74): n is a, c, g, or t
  misc_feature (90)..(90): n is a, c, g, or t
  misc_feature (140)..(140): n is a, c, g, or t
  misc_feature (143)..(143): n is a, c, g, or t
  misc_feature (163)..(163): n is a, c, g, or t
  misc_feature (169)..(170): n is a, c, g, or t
  misc_feature (172)..(172): n is a, c, g, or t
  misc_feature (174)..(174): n is a, c, g, or t
  misc_feature (177)..(178): n is a, c, g, or t
  misc_feature (181)..(181): n is a, c, g, or t
  misc_feature (184)..(187): n is a, c, g, or t
  misc_feature (189)..(190): n is a, c, g, or t
  misc_feature (192)..(192): n is a, c, g, or t
atactaccaanagaaacgaatcagcaattggcgagcgtgctattccatagcagtgataggagnttggagnnagntttacgggccggattnctgggcgggggaatgttatacgaactcttcccagatttgctgcttatggnagngggggcacgtgctagaggcnggcatnncntnatnntantannnntnncnttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaa

SEQ ID NO: 402282 - DNA, 191 bp, Homo sapiens
tggcatgatatgcttcttatcaaaatgatctgtgagctctgaaataaagcatgccggggctaccactgaagggtggtcaggacacaatactttcattaagtataatccatagtcttggaaatgatatttttttctgtagaagttatattttagttactatgccacaaaggcagctgtatgtatctttaaaa

SEQ ID NO: 402283 - DNA, 305 bp, Homo sapiens
gtttcctgcactacactggggatcgacaacctacaacctatgactacaaaatgctaaaaagctatcaatttgtagtgctctttcattgctgaaggtgaccttcaaatgtcagcacaaattaattttccatgagtgaacattgttagcagggttgagagtcacttcaacaaactatatattttatatttatagtcttaaatatatagtttttagattatatatttaatatacataaaatagacttcatgatattctctatactttcttatatatttgaaatatttcaaaaaaaacttttaaaatcc

SEQ ID NO: 402284 - DNA, 475 bp, Homo sapiens
ggacttcccctgacttggagacagccttattctcagatctctctctcttttaaaatggactatcctctttacaacccagagagccccatccaaatatcactcattgtggaagaaatctgatgccatgtcttgaggacactcaagtggcctatggagaggcgaacataaagacaagaaacccaatctcaagcactatgagactccctcctctccatctccaagggtcaggccatggtcttagtcattgccaagagcatcacagaaggcctctgcctccggttcctacctgggccctttctatgctcgttaactgatgctgcagcctgacttcttcaagactaagttgggctgtatgcttgcagtcatgggaggaaaacaaaagagggtataaacacaatgcaatgcctcgacacatcactccatctcagggggtcagaaaataaattaaatgttaggaaaaacagaaaagaaataa

SEQ ID NO: 402285 - DNA, 464 bp, Homo sapiens
gtcttggcggtggggtgagagtttctgggatggggataagaattaccaggtttagtaaggaagaattcctctccttaaatagattttaacttgaaaacctgatgacagaagcggctgagtctcagcaaagagagaaaaaacaaaggaggccgatttcaccttgacttcaccttggggacccagcagccgccgctgacccctgagggctgcagctgggcgcttcggggcaaggagtgggaaccacatcttcagtgtgtccccctgtcaggcagtaccaccctcatctcctctgcaagccacatggcttctgctctccgtggtttagctggtccaggatccactttctcaggaactcacaatgcttctcattcaggttctcatcgcccccctgaggacgggtgtattttggggacacttgatcttcatctctgcagcctgttcttattaaagttcacttaaggata

SEQ ID NO: 402286 - DNA, 364 bp, Homo sapiens
atggctcgctacagcctccacctcttgggctcaagcgatccttccacctcagcctcctaagtagctgggaccacagatgtgcatcaccatgccagctaagctgttaaagttttgtagagacggaggcctccgtatgttgtctaggctggtctcaaactggcctcaagcaatcctcccgcctcagcctcccaaaatgttgggattctgggtgtgagcaccacacctagcaacatttttattgtattgtattgtatttattgtattgtattgtattttttgagatgtggtctcacactgttgcccaggctggactgcagtggcatgatattaactcactgtagtctttgcagccttgagagaactt

SEQ ID NO: 402287 - DNA, 488 bp, Homo sapiens
ctctaagaagtaaagatgatttattcgtattttctagatgaagtaactgaggctaactctgcccaaggccacctagctaacaaagatggaactgaatttaggtttacatgaatctctattatgttgtactacttctccaagacagcatttttgatagtttatattggctgagtttagtttgtttacatatgaaaataataggccgggtgtggtggctcatgcctgtaatcccagcactctgggaggccagggtgggtggattacctgaggtcaggagttcaagaccagcctgaccaacatggtgaaacatcgtctcaactaaaaatgcaaaaataagccaggcgtggtggcgcatgcctgtaatcccagctactggggaggctgagtcaggagaattgcctgaatcctggaggtggaggttgcattgagccaaagtcgcaccgttgtactccagcctgggcaacaagagcgaaaactctgtctcgagg

SEQ ID NO: 402288 - DNA, 478 bp, Homo sapiens
atctaaacataaatacaaataagagcattaagaactaaggactatattgtgtgttttgtttgtttgttttgttttgtttttcagcctggtggcagagcaagaccatgtctcagaaaaaaaaaaaaaatgtttacacaagatgttaaagacagcatgggtcattatgtttaaattcaaaactggaaacttgtaagtgaaaatcaatcctgaactatcttgtattcagtgatattctctttataactattttacagacatctgtgtaactggctaggacaatgataatcatatgacaggatcagtcattttagtcttaaaaaaatggcaagtttttaatctatatgtgtacactggttataaaattccactttaggattttgaagtcccaggagttacatagttccctttttgaactaataagttgaacttagtggtccttaacctttttgtaccatggatatatattagaaaaaagaaa

SEQ ID NO: 402289 - DNA, 420 bp, Homo sapiens
ttaaccctagttattaaatgaagaaacttagttatggaaaggttatgagttgcctaaggtgacataactaacgaaaaaagcacaattcaaatctagacagtctatctccatagttcatgttcttaattattattccatactcaaaaagttctacaaaagtatgaatttttgcctcagtgataagaataccttacatttgcataatgcttacattttcacccaaggattttatggtcttatgttttagaggcttatttttgtgtactttgtagaattagatagctgatagaaaataatcttataaatctaaataacggacatcttggtatcacctccattttgtattgttcagagcccagaaacttccaagaaccacaagttaagaacatttattgaagcctcaaataaaagtttttgata

SEQ ID NO: 402290 - DNA, 853 bp, Homo sapiens
gcaacatgaccatccaaagtgggaagatcgaattggggaggagatgaaaagcaatcacggtccccactctgtctcccagggcctctctgccgctcagctctggagactcacagcgccacctctcggactaatgcaaggctgcagcctaaacaactcagctgatctttctctgaacttcctgtctttctgcttactctgctggggtagagtggtggggcgggtggggatggtggtagaggggcagtaattacattttatgtgttaaagtttcaccatgcagctcatgctggactagagcaaatagagagtagtgaggtcaatagggggcttccttcaagcggagtggttgatgatagggcggctcggctccaggaaagccggctgtgtcactgcagggctggcacatggcagagatggggagaggtctgccttccctcccttcctgcagaaaattgcccccacagcgcctccttttggataaggcacaaaacaccctttcttaaagttgccggtgttctggggcaacggatgaaacatcctggagaagcgtacaagctaatattagccattagccagacatccatagtcccctaacaaaaaggacaggctgtgacaatgcggggagcaagagctctgggccctgaccccagccagattgaagcctgccatgtggcctagggcaggcaggaagccacctgcagacaggggagggagagaatgtaaaagaccagggtgcagaaaggggccggccccagcatctccaggctccaaccccaccatctgtttcaccagactcatactttttatttattttttttaggatttgcaataaagcaagcctgtcttaataaaa

SEQ ID NO: 402291 - DNA, 336 bp, Homo sapiens
agcaaacgcaaactagccaagtactattcatcaaatgcattgagtttaaatttcaaactgtctcaaaacttttgtagtgctaacaaacagaggttataacttggcttatagatccctcactttactataaaaatcaacccccccccactcttctgcaacaaaacccatacagagtaattatattttttacttgtccttaactatcacaagggcttagaatatgatggaagtgaagtgatattgtttcatgattcaaacactagagagcctcatctaactgtaccagatcatcaaaaaactagggcataaaaactattatgagaattctattcattc

SEQ ID NO: 402292 - DNA, 217 bp, Homo sapiens
ccaggccgtcgctcctggctttcctgctgcctcaggcctcctcctcagtctcctttgctgtcccctctccttcccagtctgtaatggtcagcatgcccgtgggccctgctttgggtgtgtttcaagagtcatggctctaaattccttcatcttctcctcactcccaaatggacatctttagctcagatctgtccctggaattgaatctcaaatccaa

SEQ ID NO: 402293 - DNA, 783 bp, Homo sapiens
  misc_feature (750)..(750): n is a, c, g, or t
  misc_feature (757)..(757): n is a, c, g, or t
ctaggtatttaattttatgtgtagctattgtatatgggattactttttaatttattttttacattgttcactgttgacatatagaaatgctactgattttgtacattgattttgtatcctataaatatactgaatttgtttatcagttttaatagtttcttggtgatatctataggtttttccaaatataagattatatcatcagcaaacaaggacaatttgacttcttcctttccaatttggattctcttcatatctttctcttgtctgattactctagctaggacttacagtacaatgttgaataatagtaatgacagtgggcatccttgtgttccagattttaaaggaaagtcttttagtttttccccattcagtatgatactcactgtggatctgttgtatataaattttattatattgaggtatgcttttatctatattcagtattttgagggttttaaaaatgatggatgtttaattttatcaaatgctttgtcagtatcaattgaaatgatatggcttttatccttcattttcttgatgtgatgtatcatgttgattgatgtgcaattgttgaaacattcttgctcccagaattaaatcccacttgatcataatgaataatcctgttaatatattgtagaacttagtttgctactattttgttgatgatttttgcattaatattgttgtattagtctgttctcacactgctaataaagacagcatgcgcgcaggcctccgccngccaatncatatctagttcaggccgagaccgtc

SEQ ID NO: 402294 - DNA, 465 bp, Homo sapiens
gctttctttcctgttctaaagccttttaactaaacttccactcctgctctgaaacttgctctctttttctgccttaacgcccctcagtcgaattctttcttctgaggaggcaaggactgaagttgctgtggacccatagggattcgccattggtaactcggggtaactcggctctcttccactgctgacgtatgtagcaagtcctgtcttcgggttggcaggcaccacggctgacaccacatgcgcagagagaggggaaagaccaagaagtgactcatgacatcaccctcgtctctgaaagacaagatgttggtctcctcaggtgccgtgcagtcttcagtgttggctgcagccacagcccctgcaatgcagaccaggatgagggaaagccgctggaagaggcctacagcattttttattagtaaatccagaggacgtgttatataaagtgtaagacaaccacca

SEQ ID NO: 402295 - DNA, 217 bp, Homo sapiens
tttttctctttttactggtatttgttttttatactcattcactaaacagggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggtaaggggtggggt

SEQ ID NO: 402296 - DNA, 571 bp, Homo sapiens
  misc_feature (7)..(7): n is a, c, g, or t
tccgggntgtccctgtacccttgcagctgctgcagctgctgcacagaaattaatgcgaacagacagacttgaggtattgtcgagagtaccaacgtggcaattgcaaccgaggagaaaatgattgtcgggtttgctcattcctgctgacagcacaatgattgacaccaatgacaacacagtcactgtgtgtatggattacatcaaaaggggaaaatgcttctcggggaaaaagtgcaaaatactttcaaccccccctgcaacatttgccaagccaaagatcaaagctgccccaaataccaagtccaaccaggctgcagctgcataggctgcagccaccgcagctgccatgactcagtcggctgtcaaatcactgaagcgacccctcgaggcaacctttgacctgggaattcctcaagctgtacttcccccattaccaaagaggcctgctcttgaaaaaaccaacggtgccaccgcagtctttaacactggtattttccaataccaacaggctctagccaacatgcagttacaacagcatacagcatttctcccaccaggtaaggggtggggt

SEQ ID NO: 402297 - DNA, 576 bp, Homo sapiens
tcttctgcatcagtttctatgacgacataggcagccgagtagtcagggtccgtgtgctgcaggagaagagttccccgccgaaacaatgccagtgtgagaaacccgaaaagaaccatgagaatgatgtcacatgaggacagacaatgccacaggggccgtgccacaagagctcccatagaaggaactgttgctataccccaaagaaaacaaagggctctgaatggagaaaaggaatgtcctcctgaaagatccaaaatgtttcaacaagagcaatactccaaaaagccaggcagaagatgtgaatgcattcataaagaagaattgtgcataaggctatgaaaatttattactgttattattctataatatttattgtgccagacacactatattctaagagctccacatggtttaatttaatcttataacaatattataaagtaggtgctcttatccttattaaagaggaaatgaagttttaaggagctttagtaatttacaaaaggtcacaccacaagtaaataatgttttattattattattattattatttttgagactgactctcactctgtt

SEQ ID NO: 402298 - DNA, 375 bp, Homo sapiens
gaaaatgaagaagtaaagcttcgagattaattcactaattttttgttttgttctatgtcatggaataatggagactccaaaaagccaggcagaagatgtgaatgcattcataaagaagaattgtgcataaggctatgaaaatttattactgttattattctataatatttattgtgccagacacactatattctaagagctccacatggtttaatttaatcttataacaatattataaagtaggtgctcttatccttattaaagaggaaatgaagttttaaggagctttagtaatttacaaaaggtcacaccacaagtaaataatgttttattattattattattattatttttgagactgactctcactctgtt

SEQ ID NO: 402299 - DNA, 2122 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402300 - DNA, 2188 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagatcaatacagattctttttcttcctatcctgttttctctcctgtttctttggattatagcagtgaacctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402301 - DNA, 1784 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctct

SEQ ID NO: 402302 - DNA, 1307 bp, Homo sapiens
acagtaactccccattctcctttctcccaactgctggcaacaaaccatgtgactttctgtgcctgtgtttgactactctaggtacgtcatattggtggaatcatacaatatttgtctttttgtgagtgttgtcttttacttagcatagcgtcctcaaggtttattcatgttatagcatgtcagaatttccttccttttgagactgagtaattaaatagtctattgtacgtgtatcccaccttttggttttttttttaattcatctgtgacacttggtttgtttctgcctgaataatgctgctatgaacatggatgtacaaatatctgttcaagtctactttcacttatttggaatatacccagaagtggaatttctaggtcatattgtaattcttgggaagtgttttgttttgctttgaggaattaaccatattagtttccacagcagctgcacccttttacttttccatcaacctgtgtacaagtgttcccatttcatggcatccttgccaatacttactatttttttggttttgataatagccatcctatcaaatgtttttaaatgactaatatctttggaataatagatgaaactagtactaccctgaccaagtattttacagagctgtgaatcagaccttcattgggtagtgctagcattggtatgagtgccagccataaaatgtcagtcacttggtgttttcccccccaagttttgattattattaagatcttattatttaaaaagaattttaagaaatgtcagttgtcacagatgtttttctgacagaaatattatttcttatgcagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctcttgaaaacaaaaaaaacttgccgccgtttacacgtgtgactggtaaaccttgcgtaccca

SEQ ID NO: 402303 - DNA, 2384 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatataaaaaaaaaaaaaaaaaactcgagttttttttttttttttttttttttaaggtctcagttcaagtttaatacaaactacaaaagattaatgggttgctctactaatacatcatacaaaccagttgccttgccacaacggcaacttaagccatttctaccaaaggaagaaaggctggtctttccaccccctgtaggaaagccttccttgtaagacaccacaattcggctgaatctgaaagcttgggttttacctatgggaaaaa

SEQ ID NO: 402304 - DNA, 2128 bp, Homo sapiens
aaacataggctaggtacgaggccgcgtgcttaattcggccgaggccgggttgtgctgtgaagctgctgctggggtcaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402305 - DNA, 2177 bp, Homo sapiens
acccggggcccgcccccggctccatcttgcgggagaccgggttgggctgtgacgctgctgctggggtcagtgcaatgatgcaaacacgactcactgccgccttgacctcctggcctcaagcaattctcccacctcagcttcctgaatagtttggactacaggtgggcgccgctgcactggcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402306 - DNA, 2056 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagacggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402307 - DNA, 2130 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaacccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagatcaatacagattctttttcttcctatcctgttttctctcctgtttctttggattatagcagtgaacctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402308 - DNA, 1837 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402309 - DNA, 1548 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagactttctgcatctcttatagcatcgaagtaggcagctggtcggatagttccttgagtgacctgagtcactgtggcaggctgactagggtaagtaggttgtcctc

SEQ ID NO: 402310 - DNA, 1448 bp, Homo sapiens
  misc_feature (1380)..(1380): n is a, c, g, or t
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagccttgtcaataaacaatgtcgctgatgttanaacttggccatgatgcggcacagtggatacaactttctgttgggcagagagtttttttaaaaatttat

SEQ ID NO: 402311 - DNA, 1586 bp, Homo sapiens
acagtaactccccattctcctttctcccaactgctggcaacaaaccatgtgactttctgtgcctgtgtttgactactctaggtacgtcatattggtggaatcatacaatatttgtctttttgtgagtgttgtcttttacttagcatagcgtcctcaaggtttattcatgttatagcatgtcagaatttccttccttttgagactgagtaattaaatagtctattgtacgtgtatcccaccttttggttttttttttaattcatctgtgacacttggtttgtttctgcctgaataatgctgctatgaacatggatgtacaaatatctgttcaagtctactttcacttatttggaatatacccagaagtggaatttctaggtcatattgtaattcttgggaagtgttttgttttgctttgaggaattaaccatattagtttccacagcagctgcacccttttacttttccatcaacctgtgtacaagtgttcccatttcatggcatccttgccaatacttactatttttttggttttgataatagccatcctatcaaatgtttttaaatgactaatatctttggaataatagatgaaactagtactaccctgaccaagtattttacagagctgtgaatcagaccttcattgggtagtgctagcattggtatgagtgccagccataaaatgtcagtcacttggtgttttcccccccaagttttgattattattaagatcttattatttaaaaagaattttaagaaatgtcagttgtcacagatgtttttctgacagaaatattatttcttatgcagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402312 - DNA, 2446 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatatatttaaggtgtaaaaatatggtgttttgatatcagcattccttgtgtaatgattccacaattaaggtcaggctaattacgtatctgtcaccttgacatagttaccattttttcatgtgtggtgaaaacacttaagatctactaccttagcaaattttaagtgttcagtacattattaactatagatactgtgctctacattaaacctctagcatttattcgttttataactgaaagtttataccctttgaccaacatctccccattttccccacctctcacctggacaaccaccactgtgtttaagttcagctattttagattcc

SEQ ID NO: 402313 - DNA, 2178 bp, Homo sapiens
tccttgtcttgtcttgtcttttctttcaactggagtgcaatgatgcaaacacgactcactgccgccttgacctcctggcctcaagcaattctcccacctcagcttcctgaatagtttggactacagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402314 - DNA, 2067 bp, Homo sapiens
acccggggcccgcccccggctccatcttgcgggagaccgggttgggctgtgacgctgctgctggggtcagcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402315 - DNA, 1812 bp, Homo sapiens
aaacataggctaggtacgaggccgcgtgcttaattcggccgaggccgggttgtgctgtgaagctgctgctggggtcaatgtcatacccaggctatcccccaacaggctacccacctttccctggatatcctgtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402316 - DNA, 1758 bp, Homo sapiens
gtttaccagacgatggcgggcggctccagaagggtaatggaagttggtccagagcatgtttcctatactaggtggttctggtgtagagcaggggttgtctcctaattcatgaagcacggcctatgagactggtctggctggatcagaggctgtcatgtgttcgtgataaactgtatggatagtatggaagtgtgagtctgatgatcagattatacataagtccttggctagcagtgaagggtttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402317 - DNA, 1522 bp, Homo sapiens
acccggggcccgcccccggctccatcttgcgggagaccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttttttttttttttttttttttttttttttttt

SEQ ID NO: 402318 - DNA, 1170 bp, Homo sapiens
tcgagctcggctacctgtacattcgtgtcatgtgccaggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctacttttttttcgcagttgttttctttttttaaattgagttatgacaaataaaaaattgcatata

SEQ ID NO: 402319 - DNA, 412 bp, Homo sapiens
agccatacaggagaacaaagaatctcagggtatcagagagaggaggcaacatagccaagtccagtatgagaaacctgccttctggggatttcttcatatagctgttctttcagctggtctttccagcttctgtctgcccccagtaggttgcctcaaaagcccagttttcctttgatcattccaagccccagcgaaatacctctttaatgcttaatgtggcagtcacctttggatctgacttcccttctgacagttcaccaccctgtgaactggttccattgtcttccctggaaaggtagttccctttcttagcctcttattcacttctgttggcctctttttccttcctgctgtttctcctaaaacattttgctggccttcaataataaaagctttgcctaaaaaaaaaaaa

SEQ ID NO: 402320 - DNA, 484 bp, Homo sapiens
agccatacaggagaacaaagaatctcagggtatcagagagaggaggcaacatagccaagtccagtatgagaaacctgccttctggggatttcttcatatagctgttctttcagctggtctttccagcttctgtctgcccccagtaggttgcctcaaaagcccagttttcctttgatcattccaagccccagcgaaatacctctttaatgcttaatgtggcagtcacctttggatctgacttcccttctgacagttcaccaccctgtgaactggttccattgtcttccctggaaaggtagttccctttcttagcctcttattcacttctgttggcctctttttccttcctgctgtttctcctaaaacattttgctggccttcaataatattggtgtccaaattcagtttggggcctaccaccgttttatgtctctgtgggttacaattttctttgaggaatgtcctcattaccatatatttttaa

SEQ ID NO: 402321 - DNA, 329 bp, Homo sapiens
atacagctaagtacttttaacttatttttttaagccggcattggaagagaaaaatgtttttccattttatcttaaaaatctttttaataaggtattttccaaaatctctgttgcccatgagctagcaattctaattgctatgtcaagggtaattaattttatatactctcaaagccactctaatccttctatctccagattgcaaaactttgcagaacagcggctcccacttcaccttcatgaagcaaatttccagtctgctgagtacttcagcatcttggtacattaagtttctatctgtttgaattgatcaggaagaaactagcagg

SEQ ID NO: 402322 - DNA, 549 bp, Homo sapiens
cagaatatatactgaaaggaggcttgttcattgcattagtttttaaaaatgatccatagcatgtgtgtgtgttttctcatctataaaatggagatacacccctctcagaggatggttgtggtgattcagcgaggtcgtggctgtgaaagcccctttagacaatacctgcacagagtcggtgtaaatgtcactcctgttttttctgctccccaccccctcctgaactagatatcagctattttggcttaacagcttctttctcatcttaggcctgcctgaaaacgttatagttccctttctggcaggcggtggtttcaatgagtacgtatactttgaattattataaatagttgagggacaggctgcctaaagtctaattggagagttaacctaatgtctgtgaaactaatgaacaaaacgagatagtgtagatcaggaatgtccagtcttttggcttccctgggccactttggaagaattgctttgggccacacataaaatacactgatactaatgatagctgatgagctaacaacaacaaaaagcaaa

SEQ ID NO: 402323 - DNA, 480 bp, Homo sapiens
ttggtttatcactaactgttcagattctgaaggtattaatatgactggaaagaccatctgaggcttgtacagttctggcgtaagtcaaaatcctggttgatgacattccttctttagcaccacgtatgctacatcttcctttgccttttacattcttagagaaaaggaagaggggactggagacttgggctttctggggcatagggcagttggggcagcagaggatgatgccaccatccttactctacagcttcactattgtcttacggggacttttttcctgtgggctttcacccagcaaaagcagcagccgtcaatcatatccttgccagagagattcttaatataggagaaactgtaataaggagaaactacgtagaagtagcctgcctagcactacgttcgtaagttttaatggttggcaaaccccgagaggtggttaggacccttggcgatgtacatagcagcattgtacagctg

SEQ ID NO: 402324 - DNA, 487 bp, Homo sapiens
tttattcctcaatttatcatcaaataattgtttcgactgtgaggaaaggcagactgtgaccctgatatgaagctatttggggaggaatttagcttcacatttaggattctccttttaggcttcaaagtaaagcattattcatctattatatttctgtttttcatcaacatgtacggacccttacatatggccagccacttcatcttcaagctgtgatgccaggattggagggcaagaacaggaaacaatgactttggtgaaagtgtaaccactcttttagaacaaaaacagcacagtgttatttgaaaaattattaacatatgtgatggagcagtctgtaagcacgatcaaataaactggccaaagatgaggctaattgtaaatgggaataaaacacaccacaaacaattcacaaaaaacagattttaaaatactctcctttcatttccccattagctaaacaataaactgaaatctattcttacca

SEQ ID NO: 402325 - DNA, 887 bp, Homo sapiens
gccactgccctgtcaacttcacagtggggagagcctttctgcctgtaacaggaggactaatggctgatttcttacgaaagggcatagccttcagcacatttatcaatttgctttaggttctgagcttggactacagaaaatctttaaatttacagaaaccatcatgtatcttaattttaatgaaacacagtattcatttagtatttacagcatctaagctactgaaattgggggtaaacaaacaaaagcagggcaataaaaatgcaaacgttagaatcctaggtaggcaaataattgactcttcacagggaagttttaaatctgagaaattttaaattttgatcccagaggcccacatgtatcctaactttctacaccatataaaactgaaagaaattcctcttccaggtaagaagcacatcactgtctttggaagtacagaaggagaatcatctgatgacagccttgtcgatttggctgttgggcttggtgtccggttcatcaagttggggggtctttcccgtggtgaacgagtgactaaatacaaccgccttctcactatagaggaagaacttgtccagaatggaacactggccacttcatcttcaagctgtgatgccaggattggagggcaagaacaggaaacaatgactttggtgaaagtgtaaccactcttttagaacaaaaacagcacagtgttatttgaaaaattattaacatatgtgatggagcagtctgtaagcacgatcaaataaactggccaaagatgaggctaattgtaaatgggaataaaacacaccacaaacaattcacaaaaaacagattttaaaatactctcctttcatttccccattagctaaacaataaactgaaatctattcttacca

SEQ ID NO: 402326 - DNA, 973 bp, Homo sapiens
gcaggacgcggggagcagcaggcagagcagcggcccgaggcggcggggaccggcccgcgggctccatgggccgcggctacgccgcccgcgagggctggaaggcactagaagcgccgccggggctgcccagaggccgggtccccgctccactttgcgcaaacttgtttttctgaggtcagcgctgcgagctggctacatcgtcctcttaaggtggcctggggaagttgcggcgacctcccctcgcctccggactccggccgcgcggctactcccgcttcccactggcgagaggctggaggcggcgaaggagtcggggagtggaggcgcgggggtgggggggtgtctgccttttaaccctccccaagaggtcgtgcctctgagccccaaagctgaaggcccctcttgggggtgggtgcgggccggaggggaccgatcctttcagagccgtgccgaggtgaaggaaaagctggagtggactttctgttccgggagaacatccaagatgtgctatctgcgctgcccaatcctgatgactacttcctcctgcgctggctccgaggaaaagggccccaaggcccaccaaggggcatgcccagggaatcaaggagcctgtgtccagtgttcctgggtctccggatatctcagccattgtggctccccaggtcaagaacaaggccctctggctcggagctttgacctgcagaaatcagaggacatgctgaggaagcatatggagttccggaagcaacaagacctggccaacatccttgcctggcagcccccagaggtggtcaggctgtacaacgctaacggcatatgcggccacgacggtgagggcagccctgtctggtaccacattgtgggaagcctggaccccaaaggcctcttgctctcagcctccaaacaggagttgctcagggacagcttccggagctgcgagctgctcctgcgggagtgtgagctgcagagtcag

SEQ ID NO: 402327 - DNA, 871 bp, Homo sapiens
  misc_feature (670)..(670): n is a, c, g, or t
  misc_feature (680)..(680): n is a, c, g, or t
  misc_feature (682)..(682): n is a, c, g, or t
  misc_feature (685)..(686): n is a, c, g, or t
  misc_feature (695)..(695): n is a, c, g, or t
  misc_feature (705)..(705): n is a, c, g, or t
  misc_feature (707)..(708): n is a, c, g, or t
  misc_feature (710)..(711): n is a, c, g, or t
  misc_feature (721)..(721): n is a, c, g, or t
gcaggacgcggggagcagcaggcagagcagcggcccgaggcggcggggaccggcccgcgggctccatgggccgcggctacgccgcccgcgagggctggaaggcactagaagcgccgccggggctgcccagaggccgggtccccgctccactttgcgcaaacttgtttttctgaggtcagcgctgcgagctggctacatcgtcctcttaaggtggcctggggaagttgcggcgacctcccctcgcctccggactccggccgcgcggctactcccgcttcccactggcgagaggctggaggcggcgaaggagtcggggagtggaggcgcgggggtgggggggtgtctgccttttaaccctccccaagaggtcgtgcctctgagccccaaagctgaaggcccctcttgggggtgggtgcgggccggaggggaccgatcctttcagagccgtgccgaggtgaaggaaaagctggagtggactttctgttccgggagaacatccaagatgtgctatctgcgctgcccaatcctgatgactacttcctcctgcgctggctccgagctcggagctttgacctgcagaaatcagaggacatgctgaggaagcatatggagttccggaagcaacaagacctggccaacatccttgcctggcagcccccagagctggggnagacaggggngnacnncatagctcnttggtctcgnanngnnggcctgcggnatcggcggctgccggaatagcagcctccaggagtttctagcactgacgatctccgtgatcggcagttatgtcgtaacgcccgagtacacgcacaccacctggccgtcacgcggatgcccggcaggccaacgcaacactccggcgacctcc

SEQ ID NO: 402328 - DNA, 528 bp, Homo sapiens
ttaataaactctgcactaggctaaggttccaactcactccctggaggatgctacgtctcacaggaagattacagaggcgattgcagtatgaaggcaaccagccatgtcgttgctgtctgacaaatgggatgcgattttcttgtgctttacacttggggctcagattattttcgtggaaaatttttagcactttgagatgttataacactggcatcctagagaccgaaatatgaaataacttagtacaaaataggtcctcgtgggaagccaatgtgcacgttttcccaccatattctgccaacggtgcactattctcaactactccatttatctctacggggcaaataatggatgtgttccagcacccactcaatttctgtgttttcgtctagctgaaataataatagatgtaaaatatggctctctgtctaaaattagcctctggttagacactatcagctaccactcaacacaaggaaattttacacagaaataaaatgattacataggtagaatgatgcatgattt

SEQ ID NO: 402329 - DNA, 249 bp, Homo sapiens
ctgtatccggggagcaacacagcataaatataaccctctttagtaagatgggcctttcactagctgaagccaatcattatggctcccctaagttttttatccagttatcctttggataaaaataagtaatgcgctcaggggagatggcgtgttggtttactctgcctcttgtgcccccagactgtctactgttgtcgaagagcattgacatacggggtgtgacatgaacacgaactcgcgcgggaacag

SEQ ID NO: 402330 - DNA, 1747 bp, Homo sapiens
ctgtatccggggagcaacacagcataaatataaccctctttagtaagatgggcctttcactagctgaagccaatcattatggctcccctaagttttttatccagttatcctttggataaaaataagtaatgcgctcaggggagatggcgtgttggtttactctgcctcttgtgcccccagatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggtgagcaggtgtctcggaagcagtttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctggaaggcggtcctagacaacagcgacctcatgcactgcctggagatggacattaaggcccaggggtacaaggtattctccaagttctacctgacgtaccccaccaaaagaaacgaattccattttaacatttattcattcaccttcacctggtggtgatcctcaggagcagagactgttatgaattctggcgtggcttatgaaattaaaagttgccatcaaagccattttcttttaatttcacaaacatcaggcaatttccagggttggtctagagtcttgccactaaatattgatcactcgtttaaggactttccactccattgcaactgatgccactatatttgcctagcaacttgcagctacttccttttcaaagcctcatgtatctcccagacccttctcttgaagtccaataacaagaccaagtaagaatgtttcaacaatgcgttggcaagagatgtgagatgacaacaggaacatacaagatactgtgaatctagatgttctgacctaaagatgtagtctacatagccccagcttggggtccaatccatctgtccctggcatgtgccttcatgtagtaggtgctttcctgatcccctttgcgagatgctgtgggtgctaacacctcagagctgtcctcttctctagagtggaggttttcaaagtgcatcatcagcattacctgtgaacttgctggaaatacaaatcctcaggccccacctcagacctactgaatcagaatctctgggggttggcacagcattctgatttaccaaaccctccaagtgattttgatgtattctaattttgagaccatctctagaaaagaattgctacctcttgtatggaggtacaaaagactgacctcttacatcaaggaacttcctttcccagagctcctcatggaatcaagctgaagtcagtcttcttctgagagcacattcttactcagtttttttcctctgtcctacgctgcttccctcactccccttctcctaagagcactccatcaataaaccacttgcacgagaaaaatcagttt

SEQ ID NO: 402331 - DNA, 516 bp, Homo sapiens
gtaagttttgcttttccgtggggctgggctggtctgggggatttttccattctccaaatttcttctctcccctttgcgagatgctgtgggtgctaacacctcagagctgtcctcttctctagagtggaggttttcaaagtgcatcatcagcattacctgtgaacttgctggaaatacaaatcctcaggccccacctcagacctactgaatcagaatctctgggggttggcacagcattctgatttaccaaaccctccaagtgattttgatgtattctaattttgagaccatctctagaaaagaattgctacctcttgtatggaggtacaaaagactgacctcttacatcaaggaacttcctttcccagagctcctcatggaatcaagctgaagtcagtcttcttctgagagcacattcttactcagtttttttcctctgtcctacgctgcttccctcactccccttctcctaagagcactccatcaataaaccacttgcacgagaaaaatcagttt

SEQ ID NO: 402332 - DNA, 1667 bp, Homo sapiens
agtgatctgcatgtggcagggctgcgcagtggagcggccagtgggcaggatgacgagccagacccctctgccccagtccccccggcccaggcggccgacgatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggtgagcaggtgtctcggaagcagtttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctggaaggcggtcctagacaacagcgacctcatgcactgcctggagatggacattaaggcccaggggtacaaggtattctccaagttctacctgacgtaccccaccaaaagaaacgaattccattttaacatttattcattcaccttcacctggtggtgatcctcaggagcagagactgttatgaattctggcgtggcttatgaaattaaaagttgccatcaaagccattttcttttaatttcacaaacatcaggcaatttccagggttggtctagagtcttgccactaaatattgatcactcgtttaaggactttccactccattgcaactgatgccactatatttgcctagcaacttgcagctacttccttttcaaagcctcatgtatctcccagacccttctcttgaagtccaataacaagaccaagtaagaatgtttcaacaatgcgttggcaagagatgtgagatgacaacaggaacatacaagatactgtgaatctagatgttctgacctaaagatgtagtctacatagccccagcttggggtccaatccatctgtccctggcatgtgccttcatgtagtaggtgctttcctgatcccctttgcgagatgctgtgggtgctaacacctcagagctgtcctcttctctagagtggaggttttcaaagtgcatcatcagcattacctgtgaacttgctggaaatacaaatcctcaggccccacctcagacctactgaatcagaatctctgggggttggcacagcattctgatttaccaaaccctccaagtgattttgatgtattctaattttgagaccatctctagaaaagaattgctacctcttgtatggaggtacaaaagactgacctcttacatcaaggaacttcctttcccagagctcctcatggaatcaagctgaagtcagtcttcttctgagagcacattcttactcagtttttttcctctgtcctacgctgcttccctcactccccttctcctaagagcactccatcaataaaccacttgcacgagaaaaatcagttt

SEQ ID NO: 402333 - DNA, 1611 bp, Homo sapiens
agtgatctgcatgtggcagggctgcgcagtggagcggccagtgggcaggatgacgagccagacccctctgccccagtccccccggcccaggcggccgacgatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggtgagcaggtgtctcggaagcagtttttgctgcaagtgccgggctacagcgagaacctggagctcatggtgcgcctggcacgtgcagaagccataacagcacggaagtccagcgtgcttgtgtgcctggtggaaactgaggagcaggatgcatattattcagaggtcctgtgttttctgcaggataagaagatgttcaagtctgttgtcaagtttgggccctggaaggcggtcctagacaacagcgacctcatgcactgcctggagatggacattaaggcccaggggtacaaggtattctccaagttctacctgacgtaccccaccaaaagaaacgaattccattttaacatttattcattcaccttcacctggtggtgatcctcaggagcagagactgttatgaattctggcgtggcttatgaaattaggttggtctagagtcttgccactaaatattgatcactcgtttaaggactttccactccattgcaactgatgccactatatttgcctagcaacttgcagctacttccttttcaaagcctcatgtatctcccagacccttctcttgaagtccaataacaagaccaagtaagaatgtttcaacaatgcgttggcaagagatgtgagatgacaacaggaacatacaagatactgtgaatctagatgttctgacctaaagatgtagtctacatagccccagcttggggtccaatccatctgtccctggcatgtgccttcatgtagtaggtgctttcctgatcccctttgcgagatgctgtgggtgctaacacctcagagctgtcctcttctctagagtggaggttttcaaagtgcatcatcagcattacctgtgaacttgctggaaatacaaatcctcaggccccacctcagacctactgaatcagaatctctgggggttggcacagcattctgatttaccaaaccctccaagtgattttgatgtattctaattttgagaccatctctagaaaagaattgctacctcttgtatggaggtacaaaagactgacctcttacatcaaggaacttcctttcccagagctcctcatggaatcaagctgaagtcagtcttcttctgagagcacattcttactcagtttttttcctctgtcctacgctgcttccctcactccccttctcctaagagcactccatcaataaaccacttgcacgagaaaaatcagttt

SEQ ID NO: 402334 - DNA, 1700 bp, Homo sapiens
aatgggaaggcaacagacagacccaagtggcagcagtcttacttgaaggctaatcccaagaagttgctgccctgggacactcagcgggaaagagagcaggctctgtgtgtcgccatctgctttaggtttcccattggttaatgaagcccatgcatcttggaaccctgatagttgtactctttagaaaggaaaatgactaattcttttagagcagtgttatgaaagacgtgtctgttgttaatttttaatggaagtgctttggcattaaaagcccagcaggctattaggtttacattacaataacaataattcactgtcccttagtttccttttattctgaatcctcttttggggatgccttttaattgccttctcattggcttttgttcatctttcctgttgcttttgctcccatattgtccttctctagttctatcaggcaatagatcatcttgttggttttcagagaaatcccaacctgaggttaaattcaaatgccgaatttggttgttggttcttattttaatttggaggaagccagcagagatgcttgtttggttatatatggttattaatttttacttataatatagcggttcctcaattggtatatccaggtgttacaccgcatggtattacatacaaaaccaaaaacatgagcaaattctttttaagggtcttaagaaaagttttatttgccaaccacggcaatactgaaagtaatagatactttaaaagaaaaaacatatatatatgcccacattacactaatcattgacatgaaagcaaggtacccaccctcacatgtttaatgtggaaactgaatctgcctttttcttcatttccccagattatcttctcattagaatatgaatggataaaaggaatgaatgtattgtttcatctatacaaggaaactaaccctaatgcacagggcttttggggtggttgaatatatatatatcttctgattttggcctctcttatacatgctttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtagagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 402335 - DNA, 2603 bp, Homo sapiens
tatgagaaaaggatcataactcctatcctatcattggagaaaatgaaacacaaagagttttgacatgttgctctccccaaatgaacagtgaagaatttcttgtgcctgggattgaggaaactttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaaaattgggttaaacccccgggggccaaaaaaaaaccccccccaaaaaaaaaggggggccttttcccccccccatgtacgaacaagtccgaaagagtttagaaatgtgcagcattcagagggacattgaatactttgtgaatcaacgcaaaactggacagattccaccagcacccatcatgcatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtagagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 402336 - DNA, 1844 bp, Homo sapiens
cacgcgtcgcccacgcgtccgctttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtagagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 402337 - DNA, 422 bp, Homo sapiens
gcaggctgctcaggtggagatgatgttagatagttggaaatgtcggtaggaactcagttagaacattggtatctgggatcatcattactttttaccctcagaactatttccaagcctgtttgtgttactgtgatattaggatttgtttgcattctttgtgatatgagtttatgagtttcctcagtggtgggggagaagcattctaaattggacaataagtttacagataactgaaggttgacactgtttcttaagtcacagctagccaaaatgaatggtccttttccttgcatatctatgtacacgtagctatttttctgtaggcatttgaggctcaagaatgtgaacgaataaacttcttccggaatgcattgtggttacatgtgaatcagctgtcacaacaatgtgtcaccagtgatgaa

SEQ ID NO: 402338 - DNA, 2625 bp, Homo sapiens
gccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaaatgtacgaacaagtccgaaagagtttagaaatgtgcagcattcagagggacattgaatactttgtgaatcaacgcaaaactggacagattccaccagcacccatcatgcatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttaaaattaccttcctttttggctggaagacttagaagccgcctgatcatactttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaaggtggggtcgaggagttgccaataaacttgggacagactattgatggccaagcccatctgaatttaagatgctaaagtatgaaaaaaatacatcttagaatcaatgaaataccatattttgattccattcctcaagataattttagagttataaaaccagtcctcaattttgggtcttcacagagaatctttcccttgctagaccccagaattttaaatgcatccgtcttacactttcacaaatatttgggttttcctttttcactcacaaacagcagggaggtcatgtactttttgtacaacacctgtgcactatgagaaaatggtaccttttagttattgacaagttaaaatagcactctcagtttttcagtattacagagagcaaatagtttcctctcctgctctgtgcagtagcttttccagaactatggacaaattgatcagaagaagattgattatttcctcatctttttttcttttttttgagacagagtctctctctgtcccccaggctgaagtgcagcggcatgatctcagctcactgcaacctctgcctcccgggttcaagtgattctcctgcctcagcctcctgagtagctgggattacaggcacccaccaccacacctggctaattttttgtatttttagtagagacagggttttaccatgttggtcaggctggtctcaaactcctgacctcaggtgatccacctgcctcggcctcccaaagtgctgggattacaggcgtgagccactgcgcccggcctatttccccacctttcgtgtaaggtgctactgaacatgacagcttcttgtcatgacaggaaacttgcatcagttggatatccttttgagaaactgaattttgcaaagggccaaatttccccaaactgaacgggctcaggaaatgttcctttacactcagaacattctattttaagtatattatttattgttggcagttcctcagggatttcccttttctctgtattggtcagtgtagttgatgtaaaaccgttttgtggatggaaaatatttttattttattgctcttttagtttggtaggttaaataaaggttcttggtaatttggga

SEQ ID NO: 402339 - DNA, 1596 bp, Homo sapiens
gccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatcagctgtcacaacaatgtgtcaccagtgatgaaatgtacgaacaagtccgaaagagtttagaaatgtgcagcattcagagggacattgaatactttgtgaatcaacgcaaaactggacagattccaccagcacccatcatgcatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtgaacccttgctataattttttagagatttaaaatttatggtagacatttaggacaacataagcaagtagagttctgcagttttttgaagtttacaaattgccccattctgaagaattattctttcccagttactcaggttatgaatgaattaggttttcaacatgggaagcatgaaatccacttctggatttggagcatccacttgaggagcagaggtggcagcagaggattctgagccaccaactgcagtagtggctcctttggctttgggcagcctggctgtggagtttccacggcgacacacagcctcagtggtgcaagatttctcattttacagatgaggaaataaagcctacaagtgtgaaattaatttccttacagttttcctagctgatgagggacagaaccagaactagagcctgagcccaacccacatcactattcttctaacccttcctgaagttgtgatgctcatgctgaaatttaagatgccaaatatttttgccagcactttttcagttgggagaatcaccagggtttaaatgtcagatttatttttatgtggatccctgtgtatgctgaactacagagcatgatgtttaatctaatttaaggagccactgattgtaaaacatgccattattttatgttgcactaagaagcgccccccccggagctcccatcaatttttttccccccttttcctggccacgccgatccgcctctaagagcccacccttggaacccacccttctttgctctctgattcccatatcttcgtcct

SEQ ID NO: 402340 - DNA, 118 bp, Homo sapiens
actttagtcaaagcccgtgtgtgcaatatccctcttggaggtggtctattattggagtcccatatgctttttgtttgggaagaaagcagccactgtgtcatactgttacatggagtat

SEQ ID NO: 402341 - DNA, 381 bp, Homo sapiens
acatcccactagatggggaccaccaaaccacaaaatggacctgcttgaatttggccacagtgtaaaggtgttcttagaatgcaactctctcttaacactcattccactgttgaaccagccctactctagacttttacctacttttagagacaatgcaactgattcagcagtcccttgagatggtaccttgagcaatatctccttctgctcagacaaaaagctattgactggacgctcccagaggcaagcttctgaagccctctgtctctgagaatcccaagtctgccacgttcacaagcaacagaggaagccttacattctaaggtaattagctcaggcgtttcaacacttggggtgggggtagggggagagaaatcctgc

SEQ ID NO: 402342 - DNA, 495 bp, Homo sapiens
acataaattgaatcacacaatatgtggccttttgtgtctagcatagtgttttcaacgttcacccatgttgtagtgtgtatcagtacctcatttctttttattgctgaataatattctgttgtatggatatactacttattgtctgtcttcttaattataatcatcctagtagatgtgaagtggtatctcactgtggttttgatttacattcttgtaatgactaatgatgaacatctttttattatgtttattgctatattattatatttttatgtttattgctatataatattgttgttgttattatatattctccagggagacctgtctattcaaattatttgcctatttttaaacttaatttctgtctttttatcgttgagttataagagttctttatatattctggatactggacctctgtcatatgtatgacttccaaatattttatcccattctgtggactgccttttcactttcttgatagtatctttt

SEQ ID NO: 402343 - DNA, 618 bp, Homo sapiens
cgcggtggctctcacctgtaatcccagcactttgtgaggccaaggcaggtggattacctgaggtcaggagttcaagaccagcctgaccaacatggtgaaatcccatctctactaaaaacacaaaaaagttagccaagtgtgggggcgggcaccggtagtcctagctactcaggagctgagactacaggcgcatgccaccaagcccggctaatttcttgtatttttagtagagacggggtttcaccgtgttagccaggatggtctcgatctcctgaccttgtgatctgcccgccctggcctcccgaagtgctgggattacaggcgtgagccgctgcacctggcccctcgtttgtgtgatttaatgttttgactatccctgagaagcaaaacaagtgaatagtataaagaaggctaaggaaggcaatttgaattatacaaaatcatcatacacatacaagttgagtatccttatctgaaatgtttgggaccagaagtgttttagattttggaatgtttccattatattattggaaaaggagcatttcctttttgaacatcatgtcagtactgaaaaattttggatcttgaagcattttggatcttagattctcagatttg

SEQ ID NO: 402344 - DNA, 240 bp, Homo sapiens
cactgtaaacaggctccttagaaagttcagtcacttttttgctgttatcctgttgtgcacccaagtgcttctcaaggaatgtcttttttgcaaagtgctgcagtccatttggctgcttcttgagaggagagtcgtggaccccctgaggcctagttcttaaacatctcttcttagtccccattgcattagttgtttcagaacaggtcattgagcatttcgcctttgcattttggtggttca

SEQ ID NO: 402345 - DNA, 1063 bp, Homo sapiens
tgcattgcacacagtaaaatgttgcatacatgtgcattttattagtctcacatttcactcatttaatgttgtcttctgggaaaaggaatctcaatatctatagcaaatctaattctagagtaggaagggaggaaaactttcactgctggtgtcaaaagccggagagaagagcagcctgagagccaggcttcaggcagcagagagaggggacgaaggctgccctgaagccacagtctggcagcacacaatgtatcatcagagtgtcacctagtgaataacctccgtggcctttccattctcctcagagggactcatgggagcagacgttgcctgacggtctcagccagcctgaccctgtgtctgccgatgccctgctgaccttgccacccagcacgagttgcctctcccagcttgagtccgggagcatcgcccagcacaggggctcaagctgggggtcatccctggctggggctcagtcatactcgctgcatgctctggaagatctgcaccacactccggggtaccctaccccgcctccttaccccttcacccctttcatgacggtgtcaaatgacctaccgcccaaggtggggccactctccccagatgaggaagcagacaccggttccctccatgacccttccccttgggtgaaagaagatgggagtattgcctgggggtcatatgaatgccgcagagcttattgaggggagggccaaatgacttctgggtttttctttaacttgaggtgtattccaaagattgttttaggtgtgtcagcccattcaggactggattttcagaataagcctcaatgctgctctttgttagtggacgagggcatttatttgtaatcctctccactgtaaccccactgaaataaaacagaatgttaattaaatgtgtcagagaccgtattctagtaagataaccttacaatgtggtctttttggaactgttgtaacccattacgttctgaatcttctgttatctttgaagtatcatttttggcactgatttttcttaaattacattaaaaagtttatgcagatcataaaagata

SEQ ID NO: 402346 - DNA, 1214 bp, Homo sapiens
gtcccaggagactacagcaaacgagtgtatcaaggagtgagagtgaagcatacagtcaaagatctcctggcagaaaaacgatccgggcagacaagtaactcaagacttaatggcagcgtcagttcctctcagtctccatttgtgcagatgccaggttcgccggtcacgtcaggttactacggtgtcagaagatctttcttatctgactcagacttccacaacagtaaacagttttcaaatgacgtctacacctccagcgtggggaagccgtttccctgtgagtcctccgcagggcagagccatgcggctctcctggagccctacttcccccaggagccctacggagactaccggcctccggcgctgacgcccaacgcgggctctctgttcagcgcctcgcccctaccgccgctcctgccaccgcccttccccggagacccagctcacttcctatttagggactcatgggagcagacgttgcctgacggtctcagccagcctgaccctgtgtctgccgatgccctgctgaccttgccacccagcacgagttgcctctcccagcttgagtccgggagcatcgcccagcacaggggctcaagctgggggtcatccctggctggggctcagtcatactcgctgcatgctctggaagatctgcaccacactccggggtaccctaccccgcctccttaccccttcacccctttcatgacggtgtcaaatgacctaccgcccaaggtggggccactctccccagatgaggaagcagacaccggttccctccatgacccttccccttgggtgaaagaagatgggagtattgcctgggggtcatatgaatgccgcagagcttattgaggggagggccaaatgacttctgggtttttctttaacttgaggtgtattccaaagattgttttaggtgtgtcagcccattcaggactggattttcagaataagcctcaatgctgctctttgttagtggacgagggcatttatttgtaatcctctccactgtaaccccactgaaataaaacagaatgttaattaaatgtgtcagagaccgtattctagtaagataaccttacaatgtggtctttttggaactgttgtaacccattacgttctgaatcttctgttatctttgaagtatcatttttggcactgatttttcttaaattacattaaaaagtttatgcagatcataaaagata

SEQ ID NO: 402347 - DNA, 284 bp, Homo sapiens
aatgagagaaatgaatcatgaagctatgtcttttgcatatggtatattcagaaattatagtgacttttgcccatagggcatatgagccttttaaacctaactccatagttcaaatcttgccaattcttatttactactattttttaaaaagttaccaattgttatattactttggaaatgataaaaaaaatttcaaatggtaccaagggcatatggtaaaatatgagtttctttttcacctttgaatcccagtgatcttgtgtcccctagtaagcacagtaggc

SEQ ID NO: 402348 - DNA, 884 bp, Homo sapiens
gctcactatagcctccaattcctgggcttaagtgattctcccacttcagcctcccgagcagctgggattacaggcatgcgcgccactgctcccagcttcaattcctttccttacttatttttacatttatgttcttccttaaaatgaacatcttgaccgagcgcggtggctcactcttgtaatcccagcactttgggaggccgaggcaggcggatcacgaggtcaggagattgagaccatggtgaaaccctgtctttactaaaaatacaaaaaaaaaaaaaaaaaaattagccaggcatggtggcgggtgcctgtagtcccagctacttgggaggctgagtcaggagaatggcatcaacccaggaggcagagcttgcagtgagccgagatcgcgccactgctttccagcctgggcgacagagcgagactctttcaaaaaaaaaaaaaaaaaaaaaaaaaagaacatcttaacatatactgccttgttctccatttggctatgaatctatcacactccagcacttgtttcttgttacctgtgtgggtgctttacctgcctagaatagagttaaagctcctaatgacaacctattggtatgaacttttggaacctccagtgccacatttataagaaatcaaaatcttgttgatcaattgacaatcaatatgggaaactattgtttcccatcaatatgtgagattatgcttttgcttaattttattgggcacaaatattgttgaacaatttatttgaatagtatgttgttgcctttatagatatccatttccactttcttagttgatgatttttcactctacattatgattttcacttatcctttgagtgtttgatctacaaatgattgcttgcccaggtgatgaag

SEQ ID NO: 402349 - DNA, 322 bp, Homo sapiens
tttgtcaccaaggtggctctctgcaaatttgaggtggttctagaagatctttccatatttcttaatccagagggagatggagatgggtgagaaatggctttgtccatgaggaactcatgttctggttggaggacaggcggagcctggcattgaagttggtgagtcagagacggatctgtgggtggggccagaatggggcttgggcttcagacctcacaaagcagaccacatggcagcctggggcgttagtatccaaacgtcctgccctccaggttttattccttgccataaaatatcacattaaaggaaaacgttttgttaa

SEQ ID NO: 402350 - DNA, 432 bp, Homo sapiens
gtgagccgagatggcgccactgcactccagcctgggcgacagagcaagactccgtcccccccgcaaaaaaagaagtctattcccttatctaaagactgaggtctttgtactttttctttttctttttttgaggcagggtcttgctttgtcactcaagctgagtgcagtggtgccattatgggtcactgcaggctccacctgggctcaaaccatccacctgcctcagtctcccacctcaacctcccaagtagctgcgattacaggcaagtgccaccacacccagcttatttttttgtgttgttttgtagagctgggggaggtctcattttgttgcccaggctggtcttgaacgcctggtctcaagtgatccttccgccttggcctcccaaactactgggattacaggcgtgaaccaccatgcccagcccattt

SEQ ID NO: 402351 - DNA, 420 bp, Homo sapiens
actatcgactgtgactatgtactgacaagagcttcaaaatcgtacatctcaaagccattccatgcctgtcaccaagcaggctggtagggtgccatccactgcccctccaggtcctgctgcctttcaggcccctccctgagttttccataatttttctggaggcgcatagccccgcaggcatctcctgccccatctgttcttccggaggactgcactaaggctctttcttcctctgctcctcaagactctcaggaagcccaaagagttctattctcaaaaggtggagcagatccccaaggggagcactgccaagagttccataccagatgcagaatagctatggcttttatataattaccaacttaatggtctgtaaaattcactatttaaagtaagaaaaagggttttgaaagtctttga

SEQ ID NO: 402352 - DNA, 412 bp, Homo sapiens
tcctacaactgtggatgtatagggttgaaagacagaatcaagtgttctagagatggcccatcagaaataagcaagctctactatgccagtgctctagtctaagaacatggacttcagagtggggctcatgcaggactgaggattctaggcaatgctacgggagcggattccagagtagaagccgacatgctagggaggtagtgctttgtttaagaggcatggttgctcagtgctctactggtttattgaattctgtagctgggtgaccagatgccagatgtagaaagcatttataccaagctggccaaggtcacgggagaggctattgaaaatcaatctgtctctgtgtttagttcacagaggaccaggaggaacctgaaaatgaggccatatatgtgagaggatatgagag

SEQ ID NO: 402353 - DNA, 432 bp, Homo sapiens
tgattacaggaagatgaaaggtgatagtagcaaaatgaaaaagaaatttgacctgaggcatgcagcctgaagcaagtggaaagccaaatcatatgtgtggaattgactcttccagttagctctccagaaaactcccttattgccaggaaggctttaatttgattagcaaagggctgcaggaaaagggcatgtgaaaccttgaggctggctagctatccttagctccaaaccaaattaattttgggagatttatcataattcccttgctgcagcacctaagcccatcctgagtaagcttcctgaaactcaaaagaatgctgtgccctggaccctgtgtttctgcatgtaactctgggttcacttcactgctgccgcctgtatccctgcctccccagcttcccactgcctgtctacttcacatccttattgcac

SEQ ID NO: 402354 - DNA, 344 bp, Homo sapiens
ctcctccttccccaatccaactcgggccagaggcgtttgtcatgtattcacatgccaaaaatatctccactatttcaaggtccccagccaaatcccaccagctgtctcatgacccaccctccaaatatttctgttatattttggattcttgaacactagtcaaagtgataaagaagaaaagtagaaccacttggcttgttaaaaaaatttaaaaatagccaggcgcggtggctcaagcctgtaatcccagcattttgggaggccgaggtgggtggatcacgaggtcaggagttcgagaccagcctggccaacatggtgaaacccccatctctactaaaaataca

SEQ ID NO: 402355 - DNA, 610 bp, Homo sapiens
ggaggataactacagctcttacatgtaagacaaaaagtacaagggaatattatgaataacatgtctaacaatttgataacttagatgaacaaagtccttgtataacacaaattagcaaaactgtctaaagaaacagaaaacttaaaacatctctacatcaactttaaaaatgaattcgtaatttaaaacgtttctaaaaacaaaagtcctagcacaaatagtctcactagtgtgtcaaacattcaagaaagattatcaatctacacaaactgtttcagagaagaggaggtggaaagacttgtgaaccccttttatgaggctggtattattactctgataaccaaagctagaaaaaatttaagaaaccacaagaaaactatagaccaataactctcacaaacgtagatgtgaagatctttaacaaaatattaacaaataaaattcagcaatatacaaaaatgatgttatgaccgagtgatggatttatcccattaactcaaggttggtttaacatgggaaatccatttatttaactcaccatattaagagaataaaggagaaaaaaatatcatctcaataaagtaactgacaaagttcaacagtcactcaa

SEQ ID NO: 402356 - DNA, 561 bp, Homo sapiens
tttgtctttataagaagaggaagatcgaccagagctctctctctcttctctaggcatgtgctctgagaaaaggtcatctgaggacaaagtacccgtctgcaagccaggaagagagcccttgccagaaactaaaccccgctggaaacttgattttgcgctttccagcctctagaactaatatgtgaaaaacatttaaatcagaaagtaaatgacaggatgatttgcaagacacagggatgtaaaattaaaaagcctctcgagctccaaagaagcagattctgctttgctctatttgtgaaagacaactggatgagtaaagattactacttgcaaggagactagcaatttatccaaaattggaaacagagaaaacggcatcttcttttcactcattctgactcaaaatgggtgtagctcatcagagtacatcgttacattttcgggacttttgctacctggctcacatcactttggtagcttgaactctgccatgattgggaatatttacaccacaaaaatgggctaatctcctaggaatggattctaggacggcatcagcat

SEQ ID NO: 402357 - DNA, 483 bp, Homo sapiens
tttgtctttataagaagaggaagatcgaccagagctctctctctcttctctaggcatgtgctctgagaaaaggtcatctgaggacaaagtacccgtctgcaagccaggaagagagcccttgccagaaactaaaccccgctggaaacttgattttgcgctttccagcctctagaactgtggacaccgaaattctttgcctgaaaaccttttaaaaatatgaaaacaagacaaaaaatggctgggttttcttttagagtggcaatgtcatttgtccagaagggggagctctcagtccgcatgcagcggagcaaggcagacagtctggtatcttatctgctgcttgggaaattgtctgacaggaaaatatcaacacaaaccatgcgatttgccgctggagcacgctggacctcatctgcttaaaaagatgcacggatatagtcatcacagttcataatttaataaactgctaaaaaaaccaaacat

SEQ ID NO: 402358 - DNA, 467 bp, Homo sapiens
tttgtctttataagaagaggaagatcgaccagagctctctctctcttctctaggcatgtgctctgagaaaaggtcatctgaggacaaagtacccgtctgcaagccaggaagagagcccttgccagaaactaaaccccgctggaaacttgattttgcgctttccagcctctagaactaatatgtgaaaaacatttaaatcagaaagtaaatgacaggatgatttgcaagacacagggatgtaaaattaaaaagcctctcgagctccaaagctacctgttaacttcaacaagcacactggcctggagactacatgatggtgtatcagtaatggtgcctctccatcattgcccatcaaagacatttctgatgctccagaaggatacccttgaggtcatcctgttctcacctccaatattcattatgatctctaacatcactatatacaacatttttgtatatatagaata

SEQ ID NO: 402359 - DNA, 556 bp, Homo sapiens
tttgtctttataagaagaggaagatcgaccagagctctctctctcttctctaggcatgtgctctgagaaaaggtcatctgaggacaaagtacccgtctgcaagccaggaagagagcccttgccagaaactaaaccccgctggaaacttgattttgcgctttccagcctctagaactaatatgtgaaaaacatttaaatcagaaagtaaatgacaggatgatttgcaagacacagggatgtaaaattaaaaagcctctcgagctccaaagggggatgcatcaggacgataattccaagagttcaatggtgaatttccttggcttccactgagctacctgttaacttcaacaagcacactggcctggagactacatgatggtgtatcagtaatggatttacaactgcaaacatctcaagcagcagtgccacatccctgctacctccctgcttgtgcgtgtgtccctacattatccaaaataggggtgggctaatgacgattgcaggctaactccagcctaccacttgcttctataaataaagtcttattgtacacaaa

SEQ ID NO: 402360 - DNA, 303 bp, Homo sapiens
ttttatgagtccagtctgttgaaagataagaaaactatcacagtggagatggaagatggaaattgggctcagagagcaaagaagggtgaaaaagatatggacacatatatccatggcacaaattttaatgatttctgtaaagtataattaaaggaaattacaggaagtttcatttgattttcttagaggtcctgaaactcacgagtgttacagagttatagtatttacagaaagaaaggctattaaaattcaagagaatgtggaaggagctgccgtcttttttgaaaaaattcctttacattg

SEQ ID NO: 402361 - DNA, 589 bp, Homo sapiens
agcatgtatggagatgtcagatgcaatccctgtattgtaaggcaatgacatttaatgaaggataagatgaattcacagataactagaactcagggccaaacgcacacagcctgtagcaacagtgtcatgctgagatttaaaggaagaagaggtgccgtggcagaactccacgtgaccgtcccctccctgcacgcagccaggatgagaggagcagagctgagcgccacctccctgtcggtgccacggctgaggtgaggagctcttgccggatggtggggtgggggcagcagggcagattgaagtcagggattctcttatacctgagtttggaatgcctcctattcaaacaaagcaaaatatctaacagatggttggatatgagtctcagggaggaattcaatttgaaaagcacagaattaacatgtattgcttatatgaagaatctcagctagaataacaaggtcggatgggaggaatcaggactgatttgaagcacgatttactaaatcattctttccttttcctccttagcagatcataccgccagctgcttaacacgtaatagtttaataaattgtttcttcttacc

SEQ ID NO: 402362 - DNA, 618 bp, Homo sapiens
attcactagtagaaactgagaagtaggtgggggtggggcagggactgttaggagaaagtaaaagcccagcctttattttttactgttttatttttgtttttgataattagaaaaatacaggtagtggtatggttttaaaaaaaaattaaagataatcactagaaaattcaaagtaggatgttcacattccacgtcacacatctacatgtgtgaggatatatgcattcctcgctggaggagggaaaacaaaagataaatttgatcacaggataaggtcatgtcacgcaaaaattctatggtatttggttttgtaaattggcttttaaaacttacttagaattttggtctggcatggtagctcgtggctataatcccacggttttgggagttgaggcgggaggaacacttgaggcaggagttcgccaccagcctggggagcaaagtgagacccctgtctcttttaaaaaaaaaaaaaaaattatccaggtgttgtggcatgctactcaggaggctgaggcaggacgattacttgagctcaagagtttgaggccgcagtgagctgtgatcatgtctctgcgttccagtctgggtgacagagcaagactgtctcaaaaaagt

SEQ ID NO: 402363 - DNA, 669 bp, Homo sapiens
taaagacagctctcactgtgttgcccaggctggctcctgctcttgagtgatcctcccacctcagcctcccaaagtgctgggctaacaggcatgagccactgtgccctgcccttgctggcttgttgtttggggctgccatcagctcctagaagccacccacagttccttgccacatgaccctctcacaacatggcagttcctatcttcaaagccagcaagaaagtctctctagcatacccagcaagaatgtatagggctgttcagggctcacagtagattacctttctcaacagatggagtagggggtgacttaaagtgtgcataatctttaaaaattagcattttccatttgtactctctaaatttgggttagctggatccaaaccccatgattctgctacatatgggatcccagtccacctatctctagcatacttcctctattaatcattctctcttgacatttgccacctcattttagccagctgtgcttgttttcacttatgttattttatgagcagtgcttattttgacagcagcatacatagtggaatgatggctggttctggcatttaaaaagctggattcacattcaagctctaccatttgccaaataagaaaccaatactcccatcagccaactcaagtagtaaagttggaatagcatag

SEQ ID NO: 402364 - DNA, 466 bp, Homo sapiens
tcaggtgtcagccaattggaaaacacataagtggacaacctctgagggctgacttctgaccttggaacaagaatgtctttgagaggaggaggacatgggcaaacctgactctggtcacctttccatgaggaacacctacaagctctgaaagtggtgagaatccacagtggccgaatggaaggtcaaccttgacaatcctgtttgagcccgggaagcctaacctgcatcttgggaaggatctataggagatgggctggcagaacaatccaaaagggttcctgacaaagaaatacaggactcagaaactgacattcaacatcaagtatcagactgcagaaataagcccagggcataatgtgatggaggactcaagatattaggagaaatcattgaaaaagttaacgccaggttagttaaagtgaattatttcaagttcaggccattgctgcatcctggtaccggctgg

SEQ ID NO: 402365 - DNA, 240 bp, Homo sapiens
ccaggagatggaggttgcagtaagccgagatcatgccactgcactccagcctgggtgacagagcgagactctgtctcaagaaaatactttatctggactacccagactctacagtaccttccacaatggacacttgattggaaacactggatcacctgtctttgtgtatgggcaggagtgcacacgccaagaccagggtggagactcaggcctttccaaatgtctgcatggggagtccat

SEQ ID NO: 402366 - DNA, 464 bp, Homo sapiens
ggttgcagtgagccgagatcgcaccactgcactccggcctgggcaacagaggaagactgtgtctcaaaaaaaaagaaaaaagaaagacggaaagtagatactaattcccattctttttaaaatagaatgtttttaattttttttgaaattcactcatttttataagaatatttttcaaattttaatcgtagtatattgtgaatttatttagtgtagagtagaaaatgtgtgcctaactcttgatattttttccaaattctctcttttttttgagagggagtctcgctgtgtcgcccaagctggagtgcagtggcgcgatcttgactcactgcaagctccacctcctgggttcacaccattctcctccctcagcctcctgagtatctgagactacaggtgcccaccaccacacccagctaattttttgtatttttagtagagatggagtttcaccgtcttagcca

SEQ ID NO: 402367 - DNA, 330 bp, Homo sapiens
tggtactttaaaggtgacatgttaagccaagtcctgtttcccctggtaatggtcagccatatgagctccagcttgtcctgtttctacgtacggtaatagaacagtcagctaccagtcttagctgtggacaaagaggggtcagctgccctgagaagtgttggaatttttttaattaagtgcattgtctataaacttttgaacaagctgtagaactgttgtcagcaaagtaaagagccactgcatcaatgaaagttcaagaaagaaccttctgtacttaaatgtgattttcagtgttctggggttttttgtgtatgtttagaatgctgaaat

SEQ ID NO: 402368 - DNA, 470 bp, Homo sapiens
agctgctcagaggatccccctagtatatgtcgtgctaaaatactgtaggtatgtgtcaatatgagctactctgtaaatgataaataataattgactggtgagtctaggcaaggcaagtcaatgagattacaagaaaagagatgttaggccctcagaaagatggaaatttctctttgtccctgcagggactgttgcagagcattagagccaccctcaaacagttacccagtgagtctcctcaaagcaagtggcactgagatacagccttcctacaggttttcaagtcatctcgtgtggtgcacagtcctcgccctacctcgaaggcccgggcgaagttttcctgagtgtgtatactcatctcttggtgttgtctctggcagggagcaagtgagtacaggattggagtaataggcatttttaggcttgagatggctttgtgtgttgggttaatggcacgacatatacctagg

SEQ ID NO: 402369 - DNA, 420 bp, Homo sapiens
cttcagagaccttacttttaccatcttaccatgctgtcttctaaacagggataggacactttaaaggaaacacttactgccatttcaacctggaacctcagcctgtcctattccccacaacactatgagccatttctaagagatcagctccaccgtcagagacaaggcataatctcacaagcccctcctacatgcacactgaacttcacagggaaatgacaaatttaagaccaagggggaagagtaagacctactgtttgacttggccaaccattgagacacgggcagactccagatttcgaatctggccactcttcacactgggaaagaaaagaaaggaagagagaaggttattcagtatctattgtatcacatcattggaatcaaataaataattctacagattatgtgagacctaat

SEQ ID NO: 402370 - DNA, 470 bp, Homo sapiens
agagaaactcttagaaatttgacctgcttaccaattggctactaatatagagtcccccacttcctttggaaatgcttccaatctggaagattcaagaccagcttttagccaagatagagtaataggtcgtaggtttacccccatgccttacctagaagactggacaagatatatctgagacagtggttttccagatgtcatgtaacaggcaacacagaacagtaatacctaagaagaaaaactgaaaaagtaagttctacaattacaccagcttagtgcttaagggcagattccaggcctcactacagggaggggaaatgaagcctggttaattcactaagtcagggagacagagtcagagcttagaggccaaggcagccagaatttgcaaggcagatcactggaagggagggagatgcacagacagcaccagaaacctacagagggtcccctgtggtatcacttgagta

SEQ ID NO: 402371 - DNA, 917 bp, Homo sapiens
gcggccgcccgccgacatcacgtggagcctggcggacccggccgaggccgcggtgcccgcggggtcgcgcctcctgctgcccgcggtcggaccgggccacgcaggcacctacgcctgcctggcggcgaacccgcgtaccggccgccgccgccgctcgctgctcaaccttacagtggcggacctgccccccggggccccacagtgctcagttgaagggggtcccggggaccgcagcctccgcttccgctgctcgtggcccggcggggcccctgctgcctccctgcagttccaggtctccccgaaggcatccgcgccgggccagtgtcctctgtgctgctggcggccgtccccgcccacccccggctcagcggcgtccccatcacctgccttgctcgccacctggtggccacgcgtacctgcacagtcacgccggaggcccccccgagaggtgctgctgcatccgctggtggcagagacacagttgggggaggcagaggtggcactggaggcctctggttgtcccccaccctcacgggcatcctgggcccgggaagggaggcccctggctccaggaggcgggagtcgcctgcggctcagtcaagatgggcggaaactccacatcggcaacttcagcctggattgggacctgggaaattactccgtgctgtgcagtggggcgctgggtgctggcggtgaccagatcaccctcattggaccctccatatcctcgtggaggcttcagagagccagagatgcagccgtgctgacttgggatgtggagcgcggggccctgatcacgcagttttgagatccaggcatggccagatgggcctgctctgggccaggacttccacctacagggactgggtctccctgctcatcctggggcctcaggagcggtcagccgtggtgcccct

SEQ ID NO: 402372 - DNA, 800 bp, Homo sapiens
ggcggggctggagaagaaatgagaaagggactccatcttcattctctcccttctctccgcagacctgccccccggggccccacagtgctcagttgaagggggtcccggggaccgcagcctccgcttccgctgctcgtggcccggcggggcccctgctgcctccctgcagttccaggtctccccgaaggcatccgcgccgggccagtgtcctctgtgctgctggcggccgtccccgcccacccccggctcagcggcgtccccatcacctgccttgctcgccacctggtggccacgcgtacctgcacagtcacgccggaggcccccccgagaggtgctgctgcatccgctggtggcagagacacagttgggggaggcagaggtggcactggaggcctctggttgtcccccaccctcacgggcatcctgggcccgggaagggaggcccctggctccaggaggcgggagtcgcctgcggctcagtcaagatgggcggaaactccacatcggcaacttcagcctggattgggacctgggaaattactccgtgctgtgcagtggggcgctgggtgctggcggtgaccagatcaccctcattggaccctccatatcctcgtggaggcttcagagagccagagatgcagccgtgctgacttgggatgtggagcgcggggccctgatcacgcagttttgagatccaggcatggccagatgggcctgctctgggccaggacttccacctacagggactgggtctccctgctcatcctggggcctcaggagcggtcagccgtggtgcccct

SEQ ID NO: 402373 - DNA, 1268 bp, Homo sapiens
gcggccgcccgccgacatcacgtggagcctggcggacccggccgaggccgcggtgcccgcggggtcgcgcctcctgctgcccgcggtcggaccgggccacgcaggcacctacgcctgcctggcggcgaacccgcgtaccggccgccgccgccgctcgctgctcaaccttacagtggcgggtgagaggctggagcgggagtaggggaatgcctgggagaggggcggggccagaacgagggcggggctagaggaaaggggcggggccagcaaggaggagcagcataccggtgggtggggcagggccagcgggagggcgggtcaccaagaaggagctgggatacccgtggtggggcgggccagcgcggaggggcggagacacctaggataagaggcggggccagaaagaggataagggaaggagccaaatagagtggcagggatgaccaggactgacgggccggcccagcactgagagggcggacattcctgggcatggaacactcgacaaagtcgacaagcggagttaaatgacctgccccccggggccccacagtgctcagttgaagggggtcccggggaccgcagcctccgcttccgctgctcgtggcccggcggggcccctgctgcctccctgcagttccaggtctccccgaaggcatccgcgccgggccagtgtcctctgtgctgctggcggccgtccccgcccacccccggctcagcggcgtccccatcacctgccttgctcgccacctggtggccacgcgtacctgcacagtcacgccggaggcccccccgagaggtgctgctgcatccgctggtggcagagacacagttgggggaggcagaggtggcactggaggcctctggttgtcccccaccctcacgggcatcctgggcccgggaagggaggcccctggctccaggaggcgggagtcgcctgcggctcagtcaagatgggcggaaactccacatcggcaacttcagcctggattgggacctgggaaattactccgtgctgtgcagtggggcgctgggtgctggcggtgaccagatcaccctcattggaccctccatatcctcgtggaggcttcagagagccagagatgcagccgtgctgacttgggatgtggagcgcggggccctgatcacgcagttttgagatccaggcatggccagatgggcctgctctgggccaggacttccacctacagggactgggtctccctgctcatcctggggcctcaggagcggtcagccgtggtgcccct

SEQ ID NO: 402374 - DNA, 488 bp, Homo sapiens
aagggggaggacccggaaggatggggtgggggcgtaaagatgaaggttaatcaaggtcctcatggactgaaccttgaggcccttctgctgcagtcacttttgccctatcagacttttagagtaacttcctctctttatttcctctttggtggggttatcagaattattttgtgactattggtttcctttgcggtttttagtgaaattcagaatcatcttcgacggataggaaatagtgcaatcatatgtgtcagtattccggtattctaggaacttaaggaaatgcatataagggtttgaacatttttttcttcagctcactaaatgaacgaaaggtaggcgtaggcgttaaagagacacataatgtggaacgatgctgtattttcttagctactaaaacttcatttgtcattgactgtctcagggctttaaaattttatgtaggtctatattcagcttttattaaaatagaaaattccttgaaaagt

SEQ ID NO: 402375 - DNA, 355 bp, Homo sapiens
cacccaggctggagtgcagtggcatgatctcggctcactgcaaccaccatctcccggtttcaagcgattctcccatctcagcctcccgagtagctaggattacaggcacctgccatcatgcccggctaatttttgtattttagtagagacagggtttcaccatgttggccaggctggtcttgaactcctgacttcaggtgatccgcccgcctcggcctcccaaagtgctaggattacaggcgagagccaccgtacctggcctcaacttacatatttctaagaaaaagaacattttcctacataaccacaaaatcattatgacactcaggagacctataattgattgataatatta

SEQ ID NO: 402376 - DNA, 575 bp, Homo sapiens
gctgctcctgcactattttacaggtgaggggacagccctgggccacctctgtgacccgagtcaccgaggtgcagtgtgtgactggagggtcctctctgtccctgataacaagacactgagctcttactctagcagagctgggccaggagcccttaggcaacaaggcgacccctcccaggatgaggctttatttcacatactttaaagattacccaatagcttataattcgctgactaaaagcatacaagtttgctaagacaataactaaatatcacccacgtagtctccaggggaggaggaatcgctgaaaaataccatcaataaaagttaaaaactgaaaggataggtctaacagtgaaatagtttccagttttcaacacttctctttaagaaagcatactgtaaaaatgagagaaaaaaagatcttgactagaaggcatttgccagtcatagaacttacaaaaaattgtatccagaaaaacaaaactctgtaaatcaatatgaaaaagacaagcaacccatattttttgtttgaagaaggatataaggttgtttgcccattcctgagccaatg

SEQ ID NO: 402377 - DNA, 591 bp, Homo sapiens
agaaccttgacagagaatgtcagctttttatcaaggctctttcccacaatgacttctgataatgggggttggggttcattcccaggtgaaaagcatgagtttgtggcaaagaaaacagtattgtttggtcaccacactggaatggaagccaggatattctgaaggatgccttggcactaatacaaattagcaaatgactttagcacttctgagcctcaatttcttcatctgtaaaatgagaagaatggactgggtgaatatgaagtccttccactctcttaatctatgcttatgggtgctcagagcacgggaacccttccaggtgtctcttgtggttaggctgtccatgtgtcaggaccctgattgtgctcccagggacacacaagtgtgagagtggctacaactcaatggaagcaataagtaaacacgtacacactcacaaagctagatccctatatttgattaaaccatgggttagtagacaggaaccatgtcttatgcatcttcacacactcaaaatccagcccagtccaggcactgggcttaacaaatgtttactgcatgcattttgaggcaaatctttaaaatgtc

SEQ ID NO: 402378 - DNA, 947 bp, Homo sapiens
gaggagccagagagagctgcggagagctgccagctgcaccgggcgtgttccgcagctgtaggcacctgtcgtcctgccttcgatggctcctccctccgtccccctggtcctcctcctcgtcctcttgctgagcctggcagagactccagcatccgcacctgcccaccggggacgaggaggctggaccctcaatagtgctggctaccttctgggtcccgtcctccaccttccccaaatgggtgaccaagacggaaagagggagacagcccttgagatcctagacctgtggaaggccatcgacgggctcccctactcccaccctccacagccctccaagaggaatgtgatggagacgtttgccaaaccagagattggagatctgggcatgctcagcatgaaaattcccaaggaggaagatgtcctgaagtcatagatgtcttcaaatccctgttcctatccttcttctccagctcctcctgctccctctgaaaccttttctaggtaccctatgctgagactaagatcctgaagttaaatacccaggtctcatgaagacattgtaaagcatttgaattattctaaaaaatttctggagtttcttaggttttattgattcatccttgaaatcagtataatgtgctattaatggaaccaatagtaattcgaggactagttgggagattctggggtaatcagggaatattcctgcaacacatttaaaggaattgtgttcttttggaatcatcccaattataacacgagctattgcataatacaaataaccctcttaagtctgagagtctgtgtctttatttgaaaagattcttcaaattgcgtacttactcctccatattctttcaacccacatgagtctcctcgagaagtgaggagaggcagtttggagcagaatggagagaataaaatgtttcttgtcaaacgaaaaaaaa

SEQ ID NO: 402379 - DNA, 370 bp, Homo sapiens
tccatttgcggctctcctgggtaatggggtctggcaggtctgggtttgactcctttcttaggaaatctcggaactgactgaatccctctccttacgctaactccaggagaagtcgaattcgtatcctactcaattactaatgacaacaatttttgagtgcttactatgtgaggattcttatttaattgatctaataactcagtaagttttaaaaagtattagcctcatttttctgattaaaaaagaaaagtggccaggtgcagtggctcacacctgtaatcccatcactttgggaggccaaggtaggaggattgcttgagtccaggagtttaagaccagcctgagcaacatagtgagacctcatctctac

SEQ ID NO: 402380 - DNA, 269 bp, Homo sapiens
aaattaagtcatcaggtttagctcatgaagagactaaaattctaagtgtgatggcataattcactataagtcactggtgcatgaagcagtattgtttaatatcccccaacatggtaatcagggaagaacttagccatagacattatcagagggagggaactagagtagggcatggggaaaaaaaatacatacctgagttggtagttgatgggatttgtttgtgaacacctatgacacatgttaggggtggggagatggcaagaagaatg

SEQ ID NO: 402381 - DNA, 319 bp, Homo sapiens
cacatctgctttcctttcagcgaaactggaactagggtccccggcacccaggactctgcgagcatcccccaacagcaagcccttctgcaagggagacgggttggcccaccccaggctgtccagctccagcagccttgcaggcagcctctccagaaaaagagcctggtcctccccaccctgctccccacaggctgtccctgaccctgaggcccagaggcacaagaggacttctgtagagcccaggggagcaggctgttctcttggggccccagcgggctcaaggtgtggccaggctgtccccaactcaggatagatcata

SEQ ID NO: 402382 - DNA, 4234 bp, Homo sapiens
  misc_feature (741)..(741): n is a, c, g, or t
  misc_feature (1018)..(1018): n is a, c, g, or t
cccgcgcgccgcccctgcggccccctccgcccgtgtggcctttgtgccgggcgcgcaccggagagcgagcgagcgggcgggcgagcgcgagaagtacaaaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacancaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatccngagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattacagatgctttttaca

SEQ ID NO: 402383 - DNA, 453 bp, Homo sapiens
cctcctctcagttaaagagaggagtacatgagccagacctggccaatgagattcagccctaggatttttgctagaatgatttgaaaggaaattctcttgtcctgttaggttatcaagttggtaaagcacaatcccagagctgctggtagctctctttaacaatgcttttagagggtctatctgaaagtaaagccaaaccaagagacggaaacagattactgatgatgaggctggatgcagccttacctgaaggcactgtggccctggactttccagtattatgaatcaatatcttccttttctttctcttaagccatttttagttgagttttcattacttgcaacagaaagaatcccttgtaatacaaaaaaatactgttttgaaactgtgtatttcactgaatgtaacattatcatatgttcatgttattaaaattattcttcaacattatt

SEQ ID NO: 402384 - DNA, 665 bp, Homo sapiens
gaagagaggcagttcgcagatgaatgatcttattcagagccaacaacatccaagtgttttatgagaggcgaaaatagtgcagggagagcatgggaggtaaacaggtgctgctgccctgggggcaggggtggaatggggagggctggggtggggagagagctgcaccaccccatgagcttgtcagttctgatcaaagtcagcacctgcagctcccgatcaccatcgcccccttggaaaatgggtgttgattcatcatgtcaaggtcgatcactttgtagttctgcctaaaatacttaaaacattgttaggataggttttagatgtttttttaagtgcaagtattccctaaaatgccacaaattgcatcctttgaggacatctgttgcaagagaccacctgggaacatcccatcccatctacagaacccctgaagcccccagcatctgggaaggagatgggcgtgtggcaagggttgctgttatgaatcccttcctataaaccaaaggcccctggagggcagcctggtaccaaacaatgtatataaaaacagaaacattcagaaagtcttagaataacaaagcgacaggcactgactttggggaagtccggatgggctgcggacattgtgtgggatccaacagtgtcattttcctaggagtgtcccc

SEQ ID NO: 402385 - DNA, 1111 bp, Homo sapiens
ccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggc

SEQ ID NO: 402386 - DNA, 735 bp, Homo sapiens
cggacgcgtgggtcgacccacgcgtccgccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggc

SEQ ID NO: 402387 - DNA, 1103 bp, Homo sapiens
  misc_feature (5)..(5): n is a, c, g, or t
acaanagagggaggggcacacaaaacttaggctaggtacgaggctgggtgttaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctgagccatca

SEQ ID NO: 402388 - DNA, 1164 bp, Homo sapiens
tgcccccagccgaggggcagccccggggccgggcccggcgcgcacccggccagcgcgccctcgccagctgcgctctgagttctgggccagctccccagaggcctaggcgccgccgccgcgagggcgcggggcagacaaaggaggcagacaaaggcgggcgcagcccagcagccgtgcgggcaccgggcgaggcaggcccactcctcccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctgagccatca

SEQ ID NO: 402389 - DNA, 928 bp, Homo sapiens
tttttttttcctttttgcccccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctgagccatca

SEQ ID NO: 402390 - DNA, 637 bp, Homo sapiens
ccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagccctcacactcattctcaaccccctgacaaaacacatagcctaccccttccttgtactatccctatgaggcataattataacaagctcc

SEQ ID NO: 402391 - DNA, 1295 bp, Homo sapiens
cgctttccgcatgtcccgctttgcgctcccggccctgggcatcccgctgtttccctctgcgtccgcggccctgcccttttcgggggcacagctgtggtctttccaccccgcgagacagcggggcgagggggcgcgggcggccagtggatagaggctgatgcccccaagcacggacgccagcgtgggggtggaggttcttccagctgccctgagcctgtgcgaagcgggaggtccttccccagttcccacagactgtggggagggaagagacggtggaagcgagcgggttctgggctcctgggtctctggaactaccctctgcccttgccccaacactcaggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctgagccatca

SEQ ID NO: 402392 - DNA, 1131 bp, Homo sapiens
ccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctgagccatca

SEQ ID NO: 402393 - DNA, 1617 bp, Homo sapiens
ccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggcaaaaaaaaaaaaaaaaaaaaaaaaaaaaaaaaaaaaaaaaaaaaaaaaaaaaaaaaacaaaaaaacaacgacataagaagaaaaagataagaaagaagataacaagaaattaaggtgacgccgtgatcgagtgacacgtctctttcgacgattggccagacggcacactgggcgtcgaccggctgacatgatcgatgccgaacacgacacgattcgcaccgactgacaagcagcacactagccgcacagcacccagaagataagcaggaggggaggagacgacgctggcagcccgggacagcgcgcagggggggtgccaactccgagaagcgtagcgccacgcagtacaccgacgccggtcagcgcggccgacgcgaggaacacccgctcactgtgagtcgcaggagtgtgcggcgacggacaacaaccatcgcagggggcaggataagcaccgactagcacgaatgccgtgcagcgcacgcgggcgcgtgtgggaggaggcgccg

SEQ ID NO: 402394 - DNA, 1193 bp, Homo sapiens
  misc_feature (5)..(5): n is a, c, g, or t
acaanagagggaggggcacacaaaacttaggctaggtacgaggctgggtgttaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaaggtagggaggctggacctgcgggcccgggggcgggggcgtctgggccggcgggcttcctcgagcgcgccaccggcttgtgcccccctgcagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctgagccatca

SEQ ID NO: 402395 - DNA, 1170 bp, Homo sapiens
ccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcaggtgggctgcccctgcccctcgcccactagctggcatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctgagccatca

SEQ ID NO: 402396 - DNA, 462 bp, Homo sapiens
atgagcttaaggaaaacaaaaagggagcggggtagaagatttattggcccatgtaactgggaaagccaaattgtgacactggttttaggaatggctggatccagggatttggatgatgtcatagggacttgattctctttccatgtttcaattctccttttctctgtatagtggtaaagctaggctgacattcttatagctagcagctaaagagcatcctctctttcccagcccgtatttatcccttcttatcaagcatttttgatcttcccctcttcccccgtctaattaatcaccaggccacctctgaggttgaggaggcatgactgtgtgattgaaaataccaatgtataataataatacggagttgttttgttttgtttttatgtttttatttttaaacagaacgggtaaggaattctgggtaggcaaaaccaaatgatttctattacatgagcaaaa

SEQ ID NO: 402397 - DNA, 454 bp, Homo sapiens
cagatcagtaatgtcagagatactatcacatgcagaacctgaaatatttactatctttccagatattttagtactgtacaatttagtgtacatttattacattccctatttataggaatagttgtatagtaagtagactgcatttttatgataacggagatatatatatataaagtctctgtccctagatattttaccagattataaatacagcatattcaggtgcttatacaaataggtgataattttgctctgtcccttctagacatggaggcatgtagacatttatagaaatggaggatgaataaaatagcccctatagtttgaattggccatattcttttctttccttagattggtgcttatgagagactttagttagaacttttgtagtttattattttatttatttatttattttattattattattatttttgagatgaggtctcac

SEQ ID NO: 402398 - DNA, 313 bp, Homo sapiens
cagtgggttgtgtaggatgagattaggaggataaatattttggacgtgttaagtttgtggtacatgttaaatatcatccaagtggcagtgtcaaatagggagttagatatttgagtctcatgctcaaaggagagatctgagttagagttttaagtgggaatcttcagcataaatatgttacttaaatccagggacaagggcaaagtcacatgcagagcatataaagagtggagaaggctcaggactatgcctggggcagccccacatctaggggggtcagttgaaggaggaagagctagcaaaggagcctgag

SEQ ID NO: 402399 - DNA, 275 bp, Homo sapiens
agagacagggttcgctatagtggcttaactcctgggttcaagcactcattccgtctcggcctccctaagtgctgggattacaggcgcgagccaccgagcccggcctgtgggtgggaagtttccagggcagatgatggagagtgagtggcggggaatgggactcaggaatgtctgcaggagactgatgaacttgaacttgggggacttgaaaagagaacaatagaccagagcaatcaataaagcctatttcagtgaaggattacagagctgctctg

SEQ ID NO: 402400 - DNA, 384 bp, Homo sapiens
accaaagtatgcaggcaacaaagagcataatgaatgcaatggcacctcacatttcaatagtaacattgaatgtaaatggcctaaatgctccactaaaagatacagaactgcagaatggataagaactaaccaatcaactatctgctatcttcaggagactcacctaacacataaggactcacataaacttaaagtaaaggggtggaaaaaggcgtttcatgcaaatggacaccaaaaacaagcaggggcagctattcttatatcagacaaaacaaactttaaagcaacggtggttaaaagagacaaagagggacattatataacagtaaatggctggtccaacaggaaaacatcccaaccctaaagatatatccacctaatact

SEQ ID NO: 402401 - DNA, 539 bp, Homo sapiens
cagcctgcacgtcaccccactaggcatgtccaggccctttctgcccctccctaaaggcacccctgtcctttctgtcccctccacaatgagccaagccagcctccactcttgccccaggcctgccctctgctgggagccgggacactgagctcctgccacatgagcaggttgacctgcagggggcctccaagcaggtgccaaggcagaatcggatgtgaccaggagaacacccttgaaggataaagcgaatgtgcgaccaccatgcaggtctggcccatggaagggaggggagggggccccgacggggccacagtaaaggagtggaggggccccacaggcagggatggcccagctggccccctggggctgtgaatctgcaggtgcagtgcagcctcttgcctctctcagcccagcccttgcatctgcctcttggtgtgtctgtgaagacaaagtcaccgtggtccctgcagcacctggcttgaagcaggtgtgcagtccgtgtgaaagccttccctttagctattaggtattgagtcaaa

SEQ ID NO: 402402 - DNA, 569 bp, Homo sapiens
aataaatgatgacttcccccaaagctttgcttttcttcatttggcttgcgtcagaaacacaaggctcggcacagcgaaggcttgcacccgcctcccgggacccctcaggccgccacctctgctgccaggcagtccaggtcctcagcttcccggggcccttgttccgtgaactctgtgctcagctgccacaccttcactgtgccctgggcatcgcccgcagccaagagctgagtctgctggctgttgaactccagacagtagacagggctttcatcctgggtttgcttgatcaaaactgtgggtttctgggagcttttctggagattaaacagctgcacgtcacctttcccagaggcagctgcaaaaaccaagggccgcactggggaccagcgcacagcaaacagatacttgagggagagctgcagcgaagtcaagggaggggcctgcagcatggagtacaggtggacatgcccgtcagtcccagcgctcaggaagagattcctgtggaagggggaacagctcacagagtagatgggaccgccgtggggggagaaggtaaactgtgctgg

SEQ ID NO: 402403 - DNA, 424 bp, Homo sapiens
tactctttggcctcaaaacaaacccagctgaagaagcaattgatcctacatggaaaatttcaaatcatgaagagcctggtgtcgcattcaaaacacggctagttgaaaaaaaagtgaaacaaatttgtcttcgcagctataccctccacacaaacactgagtggtagaagaagttaaaaagacaaaatgataagagggcagcagttgctttttgtagcttcttggagacattaatataaatgtataaagccaaataccatggtatattcaaacacaaagagaatcctaaaaatacagcaatgaagcacatcatctaaaatatttatgctttttttttcaatgaaagaagctcagtgaaatataagagacaggatattttacctgaaatgccaaatttttaactaggatggttttcttcagctgt

SEQ ID NO: 402404 - DNA, 586 bp, Homo sapiens
agtcatgtatctgccaagtggtacagttggcacaggcagcccgggactggagtcccagctgccagagcctaaggcgagtctgagccatgtgcacttcctagggcagagcaaacccaatgcggtgacaacctgccagcatcacacacatgcagtattccaggatgctggggggctctaaatggttgattccttgcaattttcagatgcttattcttatgagctcgccagtgtttcctgtgttccgttagtgtttctaggctcgtccccaaagacaaaaatttcaggggtagtaggatcaacattccagcctatcatctctcacagcccataaaaattcagaaagtggggagggtcttgtggaaatttggaaacaatgtatagctccaaagtaggccatatcataaattaagatttacctatgtcttgtactgtactcagagttttaaaattatgcctacggaatatgacagactgacatatagttggatttaggtggaggatatgcttgtatttattgtacaattccctcaacttttctgtatgtatgagaattcttttaataaaaagttggggaagtcttaacata

SEQ ID NO: 402405 - DNA, 423 bp, Homo sapiens
agagggtgcctggcccataggggcagcacggtgactggttatgcttccttcatttgttcacccaacaaacactgactcaagcacctactaagagccaggctgaggaccttaagaatcaggacaaagtacacaggcatagtttaaacatcgtcacagcagatgatgactcagaaaatgcatttgagaaagtgataacagaagactcatttgtgtccttggcccatgtaaagaagaaaattcagagccctccgaaccaaccgaattcaataaacaccttcaaaattacagatttttatatgacatgtgttggtcacaagtaaaacctcttaaacaaagtgtggtaataatttttaaagcgcatactgctgggcacagtgaaccaacccactttatgaaggcactttaacattaaaatagcttaaa

SEQ ID NO: 402406 - DNA, 179 bp, Homo sapiens
ggtcttaaaaattgaagacctggaagagcttttgtttgtgtgaattatgtcaagatttaccatattagaaactaaaactgagaaaaattttaagttatttattaatattaaaataacagtaataaagcctgctaatacaagtaatgtgattttttaataaaaataacatttttaatttt

SEQ ID NO: 402407 - DNA, 467 bp, Homo sapiens
aataaagtgtaagattgaaaaaaaatcaagaaataatagtcgaagcatattatttagaacatggaggtgaatatcagaagaatcagctatagagacgaaagcagctgcctctggtaagcagggctgagaatgtgggaacgtatgcagcacggaactgctctttttgttataaacttgaggtatcatttggcttttaaatcatgtacatgcataaaacaaaaaacctcaacctgaaccaaatgtggcaaaatctgttaaactgagtggtgggtattctcgcatttcatatgtcactctctattcttttcttgttttaaaataattcctatttttttaaattccctttttagctctagaaattccattaatctattactcattacaatgttagttgcccctactatgtggatggagaagagcataaatgaagaaaaatacagtgttctttacattaaaggaaaaaaaaa

SEQ ID NO: 402408 - DNA, 490 bp, Homo sapiens
gggtggatgtgggcatcatcgtggtcgttgagtgtggatgccgagaggcttcacgcaggatggagggtggatgtggcacctgctgaactgagagtggatgtgggcatcatcgtggtcgttgagcatggacaccgagagccttcacacaggacggagggtggatgtggcacctactgaaccgagggtggatgtgggcatcatcatggttgttgcgcgtggacaccgagagccttcacacaggatggtgggtggatgtggcacctgctgaacagagggtggatgtgggcatcatcgtggtcattgagtgtggatgccctccagaccctgtggctttgctggacagagaagtcttgcacaggtgaggagatgaagttgatgttgggctgtgggggcccaagggctcataaaaatgaaagaacacatatttgggggcaccccatgccacacaaataagcacattttgggtaatgggttgaggtggatgaaaact

SEQ ID NO: 402409 - DNA, 346 bp, Homo sapiens
gaaggggacagttgcccacatagccaagtcagtcccagggatagtgaacaataagttgcctccagaacttcaagattaggagccactggataatgagagtcagcacagggacaaaacagatgtcaaggattcttcttttgtcatcctgagtccatgtgactaaatttcaagagggcaggttagaaaaagcaaagttgatggggcattacctgtggtttgaacttctacctgtcatatttcaggaaatcaccatgaggagcttgacttaggaaattaaggaagacgtgtccttttgttgattttcacatgggaagacaagggtgtgtgtgtgtgtgtgtgtgtgtgt

SEQ ID NO: 402410 - DNA, 435 bp, Homo sapiens
aatttacttaaggaaaaaaataattgacactagtaagtttttttatgtcaatcagcaaactgaaaaaaaaaaaagggtttcaaagtgcaaaaacaaaatctgatgttcataatatatttaaatatttaccaaaaatttgagaacacagggctgggcgcagtggctcacacctataatcccagtacattggtaggcaaggtgggcagatcacctgaggtcaggagttcaagaccagcctggacaacatggtgaaaccctgtctctactaaataatacaaaaattagccaggcgtgctggcgggcacctgtaatcccagctactcgggaggctgaggcagggagaattgcttgcaccagggaggtagaggttgcagtgagccaagatcgcaccactgcactccagccagggcaacagagcaagactccatctcaaaa

SEQ ID NO: 402411 - DNA, 539 bp, Homo sapiens
tgcccaggctggtcttgcactcctgggctccaagcagtcctcccacctcagccttccaatgtgctgggattacaggcgtgagccaccacacccagctgagtttatcaaaattgaatcagtctaagggcctcttgaaggaaaaagttaatattttaaggacacattttataattaaatgttttgaatttcatttttcagttttcatgtttcaaactgagtaattaacatttgtattatatataaagatatttgctaagccaattatagtgtatttttaaatgttactggaatataatatacatatagagaaatgcacgtatgagtgaacagttaaatgaatctgtaaagtcagcatcccctgtgtggtccacacctacattgaaaaatgggatctgaccagggctctggaggcctcctgctccttctgaggcactgccccttccctagggatgagtgcctggctcctggtgccatagactgctctgttagtttcgttcttcatgtgtataaacaagatcatgtagtattcactctcttgt

SEQ ID NO: 402412 - DNA, 1004 bp, Homo sapiens
gggttcaagcaattctcctgccttagcctcccgagtatctgggattacaggcaggcatcaccacgcccggctaattttgtatttttagtagagatggggttactccatgttggttaggctggtctcgaactcccaacctcaggtgatccgcccacctcagcctcccaaagtgctgggattataggcgtgagccactgtgcccagtgctcctctgtatttataattcacacttgatatgttcctgtgtcaattttgggtctcttttgtgacttaatttcagttcatttctatgattttaaaagttgcggggaggcttcccgactttttcagtgcccattattatcaggtactgaaattaaaaagaggaagaggaaattagatttgagagaatatggtatgtcgtgctgttgctagacattttacagacctcctttaatattcagtgaacaaggtaactgaatactgacaaggatgtgtcatgcagggatgagaatcagcctggattttagtcttcattttgttaccaagatgatttattaaccttgacaaattatttccttttctgggcttctacttcctcatctacaaaatggggaaagagtgttggatagattaggttctaatctggctctaagattttatgactgatctttttgatagcttgaaatctcaacataacccttttaattgaatgctttcaaaaggactaagtagcaatcactttcttgcttactaactcaaattacaagaaaaacaaaaagttatcccttttttccccgcaaacaactttagtgactatagaaaaaaattgaggcacctatgtagtgttgttttaagtttgcagcttctaatgtaagcttttcttctgaaaggactagggctgggtgcagtggctcacacttgtaataccagcaccttgggaagctgaggtgggaggatcacttgggactaggagttggagaccagcctgggcatcatagagcggccaccctgtctctacaaaa

SEQ ID NO: 402413 - DNA, 261 bp, Homo sapiens
ggcacagccagtgaccttgaaggattcagtgcacaggatgtaaagatcaaggtgcccccaacacatgccacacacgctaccctcacacacgctgcccacgaaaggcctcagaacacccgctcctgccccacatccacactgctcaagtccaaatcaagtccttcctgtggcacaagagcctgttgcctcctccaccccagcccccagggaccactgccgagtcccaggtgctgcagggcagatggggacccagggacagag

SEQ ID NO: 402414 - DNA, 442 bp, Homo sapiens
cttttgtgttcccaagctacaagatcaagctgcagagaccattgaagctctgcatgcagcaggcctgaaagtctgggtgctcactggggacaagatggagacagctaaatccacatgctatgcctgccgccttttccagaccaacactgagctcttagaactaaccacaaaaaccattgaagaaagtgaaaggaaagaagatcgattacatgaattattgatagaatatcgcaagaaattgctgcatgagtttcctaaaagtactagaagctttaaaaaagcatggacagaacatcaggaatatggattaatcatagatggctccacattgtcactcatactaaattctagtcaagactctagttcaaacaattacaaaagcattttcctacaaatatgtatgaagtgtactgcagtgctctgctgtcggatggcaccatta

SEQ ID NO: 402415 - DNA, 445 bp, Homo sapiens
cctgacttttgtatcttgaaggaatgacttctagtgtgtttgttcatacttggttgttgggcaatcattaaagagatttagtctagcagtccagataagagaatctctttccatttatttaatcacttcacagtcctgggatacctagactttgagtcattgctgaggctatatcgtcactttagagttgaagcaacaaaccaagaaacttatctctgaggtcatctgttcctcttcacctcagctttcatgagaggcttgtcttaaaactgagatatatatattcttagaagaggcatggtgaacatacggaaatttaaacctcagggtaacagttttccttgtacagtaataaagatgtatctggagtcagtggctacaggatcaaaaaatagatcacagtaatcggatcaaacctgagaaatggctttttgctgtgtttaaa

SEQ ID NO: 402416 - DNA, 3064 bp, Homo sapiens
cctcctgggtagctgggactacgggtgcccgccaccatgcctggctaattttttttgtatttttagtagagatggggtttcaccgtgttagccaggatggcctcgatttcctgacctcatgatccgcccgccttggcctcccaaagtgctgggattacgggcgtaagccaccgcgtctggcctattttgtttttttttaaagacagttcattattgtctatcttaatatgttagaaatcactcaaaataaagcagctgttttaacaatagctcagtagaaatagtttgttgagagtgttttacttcccaagaagttttttgatgtagttttcttagcaggaaaaatgtttgtctgttgtggatggaaacatttccccccttgcccagaacatgtgtggtttccattaacttatttttccatagaactttggccatggctgtagctgatgctgtgggtcacctgtgctattagggttaaattgagatcttaaggtacctttctccccgctgtagtccggaatgacatgggtttgtgatcagacaaactgattgaaatcccacctttttgcccctcaccggctttttcacgctggaccgactcgcttctctaagtctcagtttcctcatctgcaaaacagacttcacgggaaaacattttgcacagagctgcccctgcatcatgggtcacagacagtagtaattaatgttactggggaatgggcttttccagtactgttttcagacttaaagtcatttgttatctgtggtgtgttatgggaacagaagatgttcctgagagctgataggagagaccaggaagtgtagctgcaggaagaatgacgatgagggcacgtttggaacatcagcgtggcggatgtgggccagctgaagtgtccccagcattaagactgggaaagcagcccagtcacttctctagtgggtcccagccacaggtgcagaggacgcctgcctcccaggcagacccaggaagctgccccatggggccactctgccctagtcaaatactgcctcaggttcagttggaagtttccagtcggctcctccaaagggagttttagttgaagtcactagagctgttttattgattttggttgaggtctttgtgagctcaatttacaaaaagtctggttatccacaaaaaaatgcttgctggtgtcctgagcaactgaagaattccagaaacctttcaacaacaagtgttgagatctcccctgacccccgcctcccagcaactacagaggtctgagtttgcagtaactattattcttgtgtggaattggctctggatcgttaataagtttccctgagcgctgactaacagaaacccacttagtcacagaagaaatgggtccagtgtttgtcccagctatgagtaatgggttatgcatgatttaaaaaggcttctcagaaaggccttgcttatgtagtcaaggatcaatatttttgaaaagaagtttttataggtaagccataacattacttgataatcagacatcattttcaagtagttaaaagggtcattggataaagctcagtggaccgacactggcttcctaattgctaagggctgaaactccacatgccctgtaaattatgagcatgcttgaattttttatgggaaaagaaattatggttttatgtcggataattttcatgtcaaatgttagatcagccagccggctctatcatccaggcaggttgttgtttttccccacctgatccctgcttttccttgagaagtttattttaaatggagagtcaggaatgagagagaacgtaggataggaatgaatcatgagaaaaatgccaccagttgttttccatagtccgtgtccttgttggaatatccttacctttgtcaacagagagtagcagttcatccacaagctcgtgagcagccactggcagcactgcctccatgaggcctcgggagcattctcattgttttctccaggctgtgctgttcttcccctcagccttgagagtgaccagggatctcctaggcctagggaaacgccacctggtcattggccagagccgtttctagatatggtatctgacccctgtgtgagtaccgactgcccaagagctggcagtagttttgtactctgagcctgagcgtgtggccccacgttccatgaggcctttggccggtttgtttgccagagtgtctctgagaggagggagaatgttggtatggagaataattttattgctttcttctcaaaataaaggaaatactcaagggaatggtgggaggggaggggataaatatagcgtttccgatttcctgcttcctctactcttccacagcatttcacttttcatacggttagattttcatcctatcgacttcagctaaaaataattccaaccatttctatcagattggccctcttatcatacttgttattattttgctttcctattcaaaacctttttttccccttaggccaatgaactgttttactttattagcttcatatttatttatttgttattgatggataataggtatacatagttttagggtacatgtgatttagtaccatcatataatttataaaaatcaaatcattatatttgggatctcaatcaacttaaatatttgtcttttctttatgctagaaccattctcaatagcttttctacagggaataaaagatggtctacagtgctcacctgctgcacctggtgcatgtgtcatggtcttatggctggggcagtcttggtgtcctggcttttggatggtcagaaattctggcttgtccttgttcttccttctcccgtgatccattttcccagcagaggccattacatatgctggtgtccccctactccttccagccttctgttaacagatactgtcagcccacagccactgcagacgtggcccattgctacttccttgtccacagcaacagtgctggatacggctcagtgccttgtcagacagacaagagttgttgatgagtctgcaaagcagagctggtaggttagctgccagagctgaccccactgagcaaagcagtgagtttagtag

SEQ ID NO: 402417 - DNA, 521 bp, Homo sapiens
atttccttaggaaactattatttccccattcaaattattaaaatggagcctgtatatattttttttaattttcaatcacctattgtccctccaaaattctcacccagagggggcggtatttattttccccacctcctttctgctgccactttgcccatagatacctgtccctggacattagagaacagtgaaatatccaaaactggtgaagttacaaattccttcagaaattcaataaacatcaaaagccaaagttgccattgtaggtgtgggcggcaatcaatttttcattattaatctccatacttcttatttcagacattttggtaaatatcttctctgtatgtgtttacagcttcctgggagaagatcttcaaagccttctgttctctcaatgagcagtggctatcatgaaatctctttttcccatgtgcccacactgtcttcctgatagttacaatgattccttccaaaaaaataaatcagttcccattctcctccaagaagccagcttctataac

SEQ ID NO: 402418 - DNA, 507 bp, Homo sapiens
ctgttatgcctcttagcagaggcggagcacaatcaggaaatgagtggccgttctctccttcgtatttccagcaagttgcagttgtggctgagcaagttcctgtgcgactgcatgaaagtgatttgttggggggcagatgaacagcatggccagatgccttggagcccagctcatccaggactttcattttcccctctgaagaacagcctgtgttgttcacatgagaaccgactgcacctccgagaacatcatttgtcccgttttgtagggtagatttgccctttatgagggtggagcctgtacacaggacctgcggcagcgtttgacgttggccagggctgggaaggcttaactgttggatgctatcagggctgcttgtgagtcagaaagcttcataccacccatgaggcttgcttagtgctgtcctcgtttctggaatgacacacagtcaccttatataaaccactctacatgtttattactttctattgacatttaaaaatgatg

SEQ ID NO: 402419 - DNA, 397 bp, Homo sapiens
tgcagtagtctaccttcgccacatggcctccattgatccctgaaatgggtgaggggctccttgtttctgctgggcaggagtggactttttggatctgatctggggctgtactcatacctttgtggctgggagggttcgatatttttcagcactgtatccaatatcacctgcacagacaccttaggggatggggacttgctgttgcctggcagggatgaaagtgccagctccctaattggccacctccgacagcaccaaggtagacaggagggatgttacagcttagcaagcatgttacactgagccccctagttggcctttgctggcatgtgtggaagtggggatcaaactatatttctgtggtgttaactagagtaaagcagctcactgtctaaaa

SEQ ID NO: 402420 - DNA, 217 bp, Homo sapiens
atattttctttatagaagttcaaagagaggaaactaaaactcatttttcagccataatgtttaattaactttagagataagttagagagctatcctactgaacataatgcttttgagaactacctatattttagaagtacaaatagttgtttcattgtttgggattccatattaaatctctcttagtccattcctgctgctattgaaacttctaaaa

SEQ ID NO: 402421 - DNA, 405 bp, Homo sapiens
gtttattttcccattctgtgaatctgggttgctctcataatttttgtccaggaaagtaaagtagaagtgttgttgtgtcagctctgagcttaggcctcaagagaccttatagtttgtgttcttactggtcttggaaccccaccacgctgcatataagccctgtgccaagttgctggcagatgagagaccatgtagaacagagatgaaccatcccagcttagccatcttagaccagccagcccccagattccctggcaggaaacacagatgcatgaaaagcccagctcaaaccagcagagcttgagctcaagccaaagtaccaacccacagaattgtgagctatataaatggtggttgtgttaagtcactaattttttgagacggtttcatgaagcaaaaaacaat

SEQ ID NO: 402422 - DNA, 362 bp, Homo sapiens
aaagactttagagagaaagctaaggttaaaagaaaaataggactatgataaggtagaagttaggataatactctaggactcaaagacagcataagtaccattttaggagaaaaacccaacgctgtttaaaatattcaaggattaaggttcattaaagaggaatagtaggcatttggattagaaaattaaggctcagattatatagagtcttagactgctagagttaggaaggaatgaattgttgatggtttcttggctgaagggtgaggagttcaaaagggtgttttaagatccaaatggtataactaacctgcacaatgtgcacatgtaccctaaaacttaaagtataataaaaaataaaa

SEQ ID NO: 402423 - DNA, 343 bp, Homo sapiens
ttccagatttactacacccttgcatggacccaccagtttgtacgtgaacatttatgagtgtgagtccttgtttttttttcctgtcttgaccactggattatgaacagagaaggtcagggaacagaattgtgttccctgctctgcccagcacttggaacagcgcttggaacagagcggtcactgcgcaaataatagcggaatggataaatgaacgcaaggaggcacaggaatcccagaggccgctccaaccgggagcccgacccctcatcccaggctctaggatccgcgacagccggcgaggggcgccagggagcccaaggcacgcgccaaccctctgcggccg

SEQ ID NO: 402424 - DNA, 618 bp, Homo sapiens
aaagctcttcaccacacagcctgtcatagattcttagtgggccatgtggtgaggtctgcaggcagacctgctgctgtaacatgaaaacagggtgtcttggtttggtttctgggtcagcgggtaggcaggactggcacctagatccaaaggcaccaactaggtgcttgggaatgtggagtcagacctggaacctggctcccccagggcaagcctggagattgggtcccctaggataggcatgaatcctgatcccatataatctggcctggtttcattaggtcctaaaggtaggagcctgtcaactggatccataagggccaacctgcagctgtgtttgttgagaccaacttaaaatctgggtccacagtagctggctttctgctggtgttggctttgagcctgagtctgcaaagatcagtctgactctggggtgaacatggtgtctgcgtccacaggggcatgcctgaaatttaagtttaagaaattaaacactttttaaagttacggaatctgatcaagatgttattaagtgacctactacccagtgagagagaggattaggcataacttatttggggtggcagttattgttaaataataaaaccaattcatatttat

SEQ ID NO: 402425 - DNA, 455 bp, Homo sapiens
taaacatggcaaaggagagtttgcagtgtgattaacggtatagatctagagatgggggggatcatcctggattatctgggggcagaggggccagtctagtgacttgagtcctcaagagaggaagggaaaggcagaagggtgggttaaaaagactcactatgagaagtacttcatccttcatttctagctttgaagatgcaagtggggaccatgagccaagcagtgtgacaggctctaagaagctgggaatgtctgtcagctgacagtcaataagaatttgaggaccttcttcttgcacccacagtaaattcatttctgccaacaaactgaatgagattgtcccctagagcctccagaaaggaacacagcttactgtcatgtttattttagtttggtgaaacccaacccagactttccatctatggacctataattaaaatagtttgggggcattc

SEQ ID NO: 402426 - DNA, 192 bp, Homo sapiens
catgacccactaaattcatttcacatttgactgtgaggcatgacccacagttatggggtagctttacagggcaaagaagtacaagctgccgtttggtactcattagatacctttaactgtgctaagtattgaagaaaagcaagatactgcttacaaattgaaggcggtgaaaaggcatacaatatgggcata

SEQ ID NO: 402427 - DNA, 903 bp, Homo sapiens
cgcggagcgatgagacgttgtgaattagatgtgagaagagggacgcttggtctgcgaccaccaagaccccacaggatcgatgcacccacccctgctgatgaccatgaccatctaaaggggaacatcatttgaggggccctactcatggatcagaagcccctcttcactgtggggtgtgctgggttggcgggcagttgccgtggaatcagtttcctcaggacccatatctgaccaccctcataaggttgtcagggcgattccaacattcggggttcccagcagcccagatcccccacatccagctcttcagcctactcagagctctccacgctcactcacatgtccctctcgcaagtagcccgatcaactcacctggtgtcatgggcactaaggtgttaatggattttctctggtcacctttgcagctccactgttttgagtgagttattttaaggggagaaggtgctcctcagacggttgtcacagtgatatttttcctttgtgactgccaggttagcccctttcacctgtaagagctttgagcctagatttgttattcatttattcaagttttactgagtggtgtcatgccaggcacttgtttaggtataaggataaggcagtaaacaaaatatagactctagggacgtggaacttacattccagtgggggtaaagagatgatacataagtaaatgtagatcagatggtgaccgatgttatgaagaaatgtagactggggtaagaatagagtggcagaggaggtgctattttacacacgaagatcagggacaggtctacccttaatatttgcaagaactgagtcagtagtacaaatggaggcccacatatcatgtctacatattttaaaactacaaattaaacggtgatgtaaaattcctat

SEQ ID NO: 402428 - DNA, 297 bp, Homo sapiens
acactttagaggtatagttagcagatatttgtaattttcatgtgtttgcagactctgcaatgttgctgtcaatatatttttagtttcttcctgtttgataagggtataccatacagatgctgctgtggatgcagtattggccccagtcagagtcttgctaccatgagaatctctgctccaggcactatggtcctccctgggcttactaagccagacaagcttccacagagaatgtgatgtttattgaacaacatggaaattggatataaaacctttatgagtgtttgtatcagtaaa

SEQ ID NO: 402429 - DNA, 471 bp, Homo sapiens
gagaaggtgccttaaacaggttcccacgcatttcctggcgctattgagcttggagctgccaagggcctgccttcacttgtggcatcgcagttactgactctccagtgggccaggccctacctagctgggacctgagggtcaggatacgggaagagggctactgccgccctgacttgtaggtaagctaaaacatctaggcaaattactctgtcaactgtcctccctgctcagcctcaggaagaaataagttcctgctgggccccaggctcagccacaaaaccagactgagcacatctgggccttgtgctacaccggggtccccatcagctgctcagaccccaggaagcctcctgacttccagaacacgtcgcttcccaaagctgaccctgttccccctttcacctgccccccaagcctaagttagaaaacaagttaaaggagagaaagtgtgtgcaggcacttcagttaagc

SEQ ID NO: 402430 - DNA, 193 bp, Homo sapiens
  misc_feature (133)..(133): n is a, c, g, or t
  misc_feature (141)..(141): n is a, c, g, or t
  misc_feature (168)..(168): n is a, c, g, or t
aaatttttaacagtatagaaatttccatggaaaataaaaatgcatttgaattcaggaagaaggatactaaaatacatccaagttgagatggttccgtaggtattttttgggggggatctgattaacatttaantcagtagnctttgtataaaatagatcacccttggncctcattcaatcagttgaggcctta

SEQ ID NO: 402431 - DNA, 3928 bp, Homo sapiens
gtcgaggtgagggagtgaaatgcttaattcaggaatggattttggagtttctgggtgctgaagaaatagggcctttccgcctgcgggcccagtgagtcgacacggtgggggcccgcgatccccggaacttaccactgaataaatccagtccagcgtgcgacgacttactggcttcatggggtcgcagccgccgctggggtctccgctgtctcgcgaggagggtgaagcgcccccgcctgctcccgcttcggagggtaggcggagaagtcgccgggtacgccttcgcggatcctgccgacaccgacctagctttctgggctgccgggagctcgcggcgagcgccccagccaggcctgcgccggcatcctccgagataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaacaaatgtgtattcaacaaaagaaaaaaaataaaacagtaacactttaaaacaaga

SEQ ID NO: 402432 - DNA, 3733 bp, Homo sapiens
gtcgaggtgagggagtgaaatgcttaattcaggaatggattttggagtttctgggtgctgaagaaatagggcctttccgcctgcgggcccagtgagtcgacacggtgggggcccgcgatccccggaacttaccactgaataaatccagtccagcgtgcgacgacttactggcttcatgataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaacaaatgtgtattcaacaaaagaaaaaaaataaaacagtaacactttaaaacaaga

SEQ ID NO: 402433 - DNA, 3554 bp, Homo sapiens
gtcgaggtgagggagtgaaatgcttaattcaggaatggattttggagtttctgggtgctgaagaaatagggcctttccgcctgcgggcccagtgagtcgacacggtgggggcccgcgatccccggaacttaccactgaataaatccagtccagcgtgcgacgacttactggcttcatggggtcgcagccgccgctggggtctccgctgtctcgcgaggagggtgaagcgcccccgcctgctcccgcttcggagggtaggcggagaagtcgccgggtacgccttcgcggatcctgccgacaccgacctagctttctgggctgccgggagctcgcggcgagcgccccagccaggcctgcgccggcatcctccgagataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgagactccgcacgggggtcactcggtgaactcattatctgttcacatggttgtcccacctctaagatttgccctttaagtgacgcaggtactggctacgcttttttctcggggc

SEQ ID NO: 402434 - DNA, 2281 bp, Homo sapiens
gtcgaggtgagggagtgaaatgcttaattcaggaatggattttggagtttctgggtgctgaagaaatagggcctttccgcctgcgggcccagtgagtcgacacggtgggggcccgcgatccccggaacttaccactgaataaatccagtccagcgtgcgacgacttactggcttcatggggtcgcagccgccgctggggtctccgctgtctcgcgaggagggtgaagcgcccccgcctgctcccgcttcggagggtaggcggagaagtcgccgggtacgccttcgcggatcctgccgacaccgacctagctttctgggctgccgggagctcgcggcgagcgccccagccaggcctgcgccggcatcctccgagataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagaggagtctcggtgttaccggtggagggtgtgcagccaggttcctggcatcttgaacaaagaattggacaaacgcacatacaagcaaggaaagaatgaagccaccaaagcagccgggtggggtggcctcacgcctgtaatcccaacagtttgggagccaagacggtaggttacatgagccaggagttcgagaga

SEQ ID NO: 402435 - DNA, 290 bp, Homo sapiens
cacttaagtattttcaccaaaataagtttcaaggtctttatttgcatttttgttgagactatttagtcattcctctattatcaggttactgatatatttctttcccttttacagataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttt

SEQ ID NO: 402436 - DNA, 686 bp, Homo sapiens
gtcgaggtgagggagtgaaatgcttaattcaggaatggattttggagtttctgggtgctgaagaaatagggcctttccgcctgcgggcccagtgagtcgacacggtgggggcccgcgatccccggaacttaccactgaataaatccagtccagcgtgcgacgacttactggcttcatggggtcgcagccgccgctggggtctccgctgtctcgcgaggagggtgaagcgcccccgcctgctcccgcttcggagggtaggcggagaagtcgccgggtacgccttcgcggatcctgccgacaccgacctagctttctgggctgccgggagctcgcggcgagcgccccagccaggcctgcgccggcatcctccgagaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattct

SEQ ID NO: 402437 - DNA, 4224 bp, Homo sapiens
gtcgaggtgagggagtgaaatgcttaattcaggaatggattttggagtttctgggtgctgaagaaatagggcctttccgcctgcgggcccagtgagtcgacacggtgggggcccgcgatccccggaacttaccactgaataaatccagtccagcgtgcgacgacttactggcttcatggggtcgcagccgccgctggggtctccgctgtctcgcgaggagggtgaagcgcccccgcctgctcccgcttcggagggtaggcggagaagtcgccgggtacgccttcgcggatcctgccgacaccgacctagctttctgggctgccgggagctcgcggcgagcgccccagccaggcctgcgccggcatcctccgagataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaacaaatgtgtattcaacaaaagaaaaaaaataaaacagtaacactttaaaacaagaatcagacattttcctatgcagtatttttttttaaagtttattttagtaaagttaaaatcttgaaagtagctaagggcataattatgtcataaatactgaacttcaggtgaacaaatactttatagttttaattattttctttgattttgaggagtatcttatttgctttctatcatcagtaaaaacagcatttaacttgctaaataaacatgaaaaacccttgtcatacttcttttacattggtagttctttcatataaagtggttatgttttatcttgttttagggatgataaaa

SEQ ID NO: 402438 - DNA, 2363 bp, Homo sapiens
gacccactttcagagtagaagtgggcatgatcagaagaatcatagaaagcatcatgggaagaaaagaatgaaaagtaaacgacccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaacaaatgtgtattcaacaaaagaaaaaaaataaaacagtaacactttaaaacaaga

SEQ ID NO: 402439 - DNA, 181 bp, Homo sapiens
tgcctctgacttctgcccacttcttgaaatattttaaggctagccgtttggaaactttatcattctccagtgtaatcacagggagactgtgcttcccccaaagctgagatttcaggggccttgtagcaatggacaaattacaggtgattttggtttgtttgtttatttttaatgatctctg

SEQ ID NO: 402440 - DNA, 515 bp, Homo sapiens
tgaatcctggctatttgcattggtgggtgctacattagtgacgcccaggcagaccatgttctctactactaaatcgtattctatctctgcagaaccccagatggcttccagtgcccaaaccctactgtcagtagcttccctagagctgatagccctcagttaattccaaggcccagaaatgaaccttctcatggccccccaccagtccttgccccctgggaaaccgtttggggtgtccattgtccagcaacttttactgtattatccccctatctttctcccagaggtccctcctctcccagaccattaagtttctgacatatattaatcggttagacctttgggcttgctcagatttaagctgatagccgggcatagtgatgcgagcctatagtcccagctactggagaggctgaggcaggaggattgctggagcctgggggaggtagaggttgcagtgagccatgattgtgacactgcagtcccgcctgggtgacagagtgaggcccagtcta

SEQ ID NO: 402441 - DNA, 232 bp, Homo sapiens
cctagttttagaagtttcaatagcacctaagttatttagttgctatgaagattgaatgaattaaggcctgttaagtgtctagaggacttcctggttcttagcaatcatttaatgattgttcagatattattattgtgattattatcattttattgcattctagagtaggagagaagaaatgaacacataatcaaatagatgtgctataatgtcaagtagtgataaatgctat

SEQ ID NO: 402442 - DNA, 703 bp, Homo sapiens
ctcaaaagtgacttttttaaactttccacccccaggaatagtttttcagtcatttagttcacatgttttctgctttgactaaagtattttgaggtcccatttttgtttcctcaactgtttaagctcctttatctgaggaaactagattttctctttgatctgccaaagaatctgctacatcgtttgaccacagggtgaattctacttaaagtgactccatatttttgtggcactctcattcatccctttttaaatgctgcatctctgtcaaggtactccgcaccttggatatcaaagttgtagggcttttttgactagttaacccattgctatcaaatcttatctcagagattaatctgtcatcagtcacttttaccttcatgtgccattagtacgttacttcaattggggatatttgcaaatgaactctgtctttcaaaggtgggaagaaaagtaggagtttgtttgacataaaacataacaagttaacaaactactggcacttttgcaaagaaggcctttccaaagcctatcagcctatagaatacttttccttttgccattcattaagaagaaacagattgtccgggcgcggtggctcatgcctgtaatcccagtactttgcgaagccgagaagggcggatcacctgaggttggaagtttgagaccagcctaaccaacatggagaaaccccatttctact

SEQ ID NO: 402443 - DNA, 227 bp, Homo sapiens
ccaccccaccctcctgcactgcagcgctgcccagacctgggtctgcggagacttctgtttgcctctggcctgatgaaagcagtgtggaaaccaacctccctcctcctccccagatctcttctctttttggggggttttcatgctaacttactattttctctaattaagaagcaatacatggctattatgaaacatttagaaaatgtataataaatactaaaataatg

SEQ ID NO: 402444 - DNA, 717 bp, Homo sapiens
tcagcctcttgagtagctgggactacaggcatgtgtcaccatgcccggctaattttttgtatttttagtagagacggggtttcatcctggtggccaggctggtctccaactcttgacctcatgatccacccacttgggcttcccaaagtgctgggattacaggcgtgagccactgtgccccgcctgagaataaattattttacccaaaagactccttgcactcacgtgtttattgcagcactattcacagtagcaaagacagaattaaactaggtagccatgaatcttaaattggataaaaaaaacttagatacttgtacatcatgcaatactatgcagccacagaagacagtgaagtaatgtcctttgtagcaacatgtctgcagaagatggccattattctaagcaaattaacagaaaactattacatgttcttacttacatgtgggagctaaacattgggtgcatatggaaacaaagatgaaaacaataaacactggggattccaaaaagaagaaagaagggagagaaacagtgaaaaactacttaacaggtatgatgtatgccacttaggtaatgggattattaagtgcccaaacctcaacaccatgcagtatacctgtgttacaaatctgcacacataccctcaatctgtaataataaaatggtttgtggataatgacatgttacacttctcccgttctggcttaatagttg

SEQ ID NO: 402445 - DNA, 335 bp, Homo sapiens
gtgatggctcattgttctttaggtttgcaacctctgaatgctgagaagattgagcatctctgtatatgctagttggctctggggacttcctctactgaaaattgccagctcacatcactgacccatttttcttatgggatggctgtcttttattattaacaggaatattatatatctgtgtgtgtgtgtgtgtgtgtgtgtgtgtgtgtgtgagattaatccctcatgggtaaacatcgtgaattccttcttctgttgtgccatctgccattagctttgtccatagttccccttattgaaaaggaattattaattttgataaaacataatccatc

SEQ ID NO: 402446 - DNA, 407 bp, Homo sapiens
atgtcccatgtatttggtcatcattgtggtgggaggcacagtcctccatttgatccagaagatgcaaatgaattcagcctcagcataataggctcagaaggagtgagtccctaaagagtggcaccctgggctggggatggtggctcgctcctgtaatcccagcactttgggaggccctggcaggtggatcataaggtcaggagttcaagaccagcctggccaagatggtgaaaccctgtctctactaaatataaaaaaatcactcgagcatgatggcatgtgcctgtagtcccagcgactcaggaggctgaggcagagaactgcttgaacccaggaggcagaggtggtgagcccagatcacgccactgcactccagcctgggcaacagagcgagactctgtctccaa

SEQ ID NO: 402447 - DNA, 478 bp, Homo sapiens
acgtgttatccagaggctacatgaattgcacagcacagatctggaggaataaaagggaatccagtagccaccttctgagactccatgcctaagtcacactcaggggaactctgcccaaaatcttgtccagttctgggtcctaagtctttcatgccattactggggaattcacttgataggcttctattattctctgtctcaggaggactcaagatcagtggctttggcctctgaggacaaacaagcttatattctaaatggtatgctgagcttttcagcaggtctaactatcccagagtaggaacaactcagcactgccatccaggctcttaacacagtaatctacccgtgatagggcaagaaacaaagaaggaatcagtggtcctatcgcctcttctcccaacccctgggcccgaggcagagaactttcctagctcccattgtccctcagggcaatcatggataacagtattttttt

SEQ ID NO: 402448 - DNA, 680 bp, Homo sapiens
attcccgcctgaaccactaacaccgaaactgctctgggaaagattacctaccgccaaatcaaatggactcttttctgacctctgtaccgcattccacacaattttccctccctctgatcctccctggctcctctattcgtttcactcccggtaacgccactctttcctcttctccccatctgctgttgtctgttggtttcctccagggctgccttttctctgccagctgtttaaggactgttggttcgcaagcttccatcaattctcttttcactgtacagactctccctgagtaattgcaaacactgccaaattatatctccaggtaaaacgtctacctcaggcctcctatccatgtatatatttacacacccacccacacacacacacacatacacatacatacacagggtgccctctgtatctgtgggttttgcatccatggatttaaccaaccatggaccagaaacatttttgaatcaaataaaaaataatgcaaaatttaaaatacagtacaactatttacctaggatttacattgtattaggtattataagtaacctagagatgatttaaagtatatgggagccagcgcagtggcatgcgaccgtagtcccagctacttgggaggctgagatgggaggattgcttgagactaggagttcgacttcatctcttta

SEQ ID NO: 402449 - DNA, 379 bp, Homo sapiens
gagaaattgtatttgcagaaaaagcagaataaactactagtagaatttactgtatcacatgatactgttggatatgatctgtgatatataaagtgaatgattaatgtgctgtcattgtgaaatgtgaaatagcaagtgttccagattatggtgatccgaactgaatgtgtatatatgccctcagcttatatacagaacatatttgaagaaaaaagtattcttgtttctcttctggttatcattttttaaaaaacaatctatactacattttgttattttgtgatctgtgacataaagtggaaaaggaaaggacgttggggtcactgatgagagagcatctgctatctgtacagtaaaaaagggcattataatctcaata

SEQ ID NO: 402450 - DNA, 254 bp, Homo sapiens
caccatagaatactatgcagccataaaaagaaagggaagggtctttaactgctgctacttgcttgctaattccagtaatgtgctgatagagtcaagaactatcactaggtccagaaatagagaaaggctgatttaggctgaagttctagaacgtgactatcttatttctaaccaaaacaaaaaagagacatgtactgccaagatgtgtagttctgataatgcatcagaaatcaggacaaaaaaaacctaaagca

SEQ ID NO: 402451 - DNA, 158 bp, Homo sapiens
ttattgaggaaatggttgactgggtaatttttaaaaatcactgggcacaaaaaatatattttgacttatattagtttagagtatttacacttgaaagagtctcatcttttctgaagggtgtttctttcatacacattttattgcactgagttttgtga

SEQ ID NO: 402452 - DNA, 549 bp, Homo sapiens
  misc_feature (432)..(432): n is a, c, g, or t
  misc_feature (525)..(525): n is a, c, g, or t
  misc_feature (532)..(532): n is a, c, g, or t
actttctaactctgtaggacacagcaaatcaaaatagaggtcctgggagggatccactaatttagtgagttagacaaagaatgatttatggcagtaaccacattcaggagaaatattcctataaaaactcagcaaatatggaaaactgagcacatgaagcaaaaatatttaaagattttcagaaatttggaaaacctaaattacattttaagacataggatgtcatgatctgttttgtgctgatatagtagaatacctgagactgggtagcttataataaacagaaatgtattggctcacagttctggaagctggaagctcaatatcaaggtgttggcatcttgcaagggcctccttgctgtgccatcatatggcagaacgcacagagaaggagagaaccactccattaatcccaccatgagggcagggctnctgtggcctaacgacctcttaaaagtctccctctaaatactgatggaatgccaattaagactcatgtgagttttggaggggacaaacattcanaccttancacaggaatcatgaatg

SEQ ID NO: 402453 - DNA, 368 bp, Homo sapiens
ttgtcaaatcttcacacttcaattaagagagataatctgcttccaaaaattaactgtcaagaagtgtcgacacactaatgataatgagagcagttaagagctagggcttcagagtcaaactggctcatgtaaatacatctccttcactggtttatggtgaggattaaatgacttaatacatataaagtgcttagaacaaacttcaataaatgttagctaatattatcattattcatcactattattacacattttttaaaaaggctcaaaacctaacttcccacctctttctcctcttaccaatgaaatatactatgtcatacaatcacaaaaatgttgtacgctgctgtactgaatttctggctttt

SEQ ID NO: 402454 - DNA, 444 bp, Homo sapiens
aggtgcagtctgtgtccccgtccttgactctgagaatccctgtgatcaacagaatgcagaaaagtgacactgcatggcttctgaggctaggtccagaaaaggtgatgcagcttccccctttgcgctgaaatgcagtgcttggacctcagagctattgactaagaagtccatgcaccctgagcttctcatgctggggaagccacgtgtaggcattcagttcccagcccagctgagctccatcctggctgcaacaattgttctcatgaggaagccatcttggacactcagctccatggagcctccacgagtcgccagccccaactgacatctgtctcactgcaaccacagaagagcctccaaccaagaactgcacagctgaaccctttctaaattcttgatctccaaaaagccatgcacaaaataaaatggttgttttgagccact

SEQ ID NO: 402455 - DNA, 315 bp, Homo sapiens
tgttattaagccataaccaagtcagtgctgtttctacagaaacagacaagttaacaagtgaaacataatagagagcccagaaacagacccatacatattttggatttgtcacgtgaaagaagtagctttgcaaaactttgggaaaaggagagtgtgtgcaatagatgatgctcgtgctcatgcagacaaaaaggaaattgggatacctgcctcttaccgtacacaaacaccaacctaaacgtgaaagttaaactataacagcttgaggtggtggggaagaaatatctttatctcagtgtagggaagaatttattt

SEQ ID NO: 402456 - DNA, 594 bp, Homo sapiens
ttttttttttttaagacagagtctcactctgtcgcccaggctggagtgcagtggtgtgatcttggctcactgcaacctccacctcccaggttcaagctattctcgtgcctcagcctcctaagtagctgggactacaggggtgcgctgccacgcccaactaattttttgcatttttagtagagatggggttttgccatgttgcccaggctggtcttgaactactgagctcaggcaatctgtttgcctcagcctcccaaactgctaggattacaggtgtgaaccaccacacctggccagttctctaattttaagtgaaaaaaatacctccctccctcccagggttattatagtgacagagaccttagcagtgtgtcttgcattcagtaagcactcactaaatgttagtgctgctgttatttatcacatacatcttcagaaacaccgaggatcctaggattcttatagttaccacctacttgtcacccattaatgttaacatttataaactaactccccagaaatattaactgtaaccttaaaccacctattttgactgagcatataaatacagcatataaagaactgcagttttct

SEQ ID NO: 402457 - DNA, 540 bp, Homo sapiens
ttttttttttttaagacagagtctcactctgtcgcccaggctggagtgcagtggtgtgatcttggctcactgcaacctccacctcccaggttcaagctattctcgtgcctcagcctcctaagtagctgggactacaggggtgcgctgccacgcccaactaattttttgcatttttagtagagatggggttttgccatgttgcccaggctggtcttgaactactgagctcaggcaatctgtttgcctcagcctcccaaactgctaggattacaggtgtgaaccaccacacctggccagttctctaattttaagtgaaagtcttgcattcagtaagcactcactaaatgttagtgctgctgttatttatcacatacatcttcagaaacaccgaggatcctaggattcttatagttaccacctacttgtcacccattaatgttaacatttataaactaactccccagaaatattaactgtaaccttaaaccacctattttgactgagcatataaatacagcatataaagaactgcagttttct

SEQ ID NO: 402458 - DNA, 589 bp, Homo sapiens
catagatttttgtttttcatattttgttcactgtggtatcccctcttcctggaatactccaatattaatagaattgtatatttgaagaacgaattgataaatgtgatggaaatttgggttggataacctataaacacttgctttttggcagtatttttatacagtctttttctgcttgtcaatcttgggtattttccccattataatagtgttttcatattttccaagaatttctatatatgaaagggttaagctccaccaaagatttgcttggcttatttacactaaaggaaaatttatatcaatgtgacattctaattatttggaaaaaattaattctgatatacctaaattcttatttagtagtgaattccaaagttatcttttcatcagaatttaaattcacagatttaccatttatttttcaggattttagtgtttaagagtcattattacatgtgttagttttctgagatgggactgattaaggtcttgagagaaggctagtggaagtggggtgaaagagaagaagaagtgaaggagaagaatggtacaggatgatattgggaggtagacagaggccaaaata

SEQ ID NO: 402459 - DNA, 430 bp, Homo sapiens
gaacatggctgggacaaaaccaacaaccatgaggcatggtcttcatttatattcatgaccacatatatcaactggactaatttcccaatgaatttatttagtatgtttgcatttatattttccgagttgaataatttacaccacctcctctccaaatgtttgttatttcggttggaataaatggtgtcagaaatgaaacctgaaaaagaacactattggaagggattggcaattcttggaactggtgtgcaggacccactagagccctttgagctctctgcttccaaggcttgcctgttcttccctggtgagtcttctctcaggctgagcctctctctttttggtattatttgatattatttgggatctggtttggatcacgcaaccttaataaagaccatacatctctccttgaatgataaaaagactt

SEQ ID NO: 402460 - DNA, 528 bp, Homo sapiens
agtaactaaaatatttaagataaatgttgaattttttaaattctaagaaatttggtttgtataactcaaggcattacaaaaccttgaatatttacaggtctaagacaagcaatgaaaacgagtgaagcaaggacaatatgaaagaaaatggagtgattgtaatgtcattaagccagcaagcccattcctcgctgagaaaagcctgtattatcatagcctagtgccacagactactgccatgcaggaaggtgcaaaagaactaaaaaatctgtatttttctatgaaattccaagacttttaagtgttagtaaccaatttttcaatatcacatcatacaggtcaaatcaaacaaatgattagctattttcttctactggaacaagaaccgtaagttctctcagggtccgagaagtctgggactgatgggctcaactaacatgcgaaggctaacaggaaaaactgctgcacctggaaacacagagaacaaattttgaaaagaaaaagaaaacatctttaaagataaagaga

SEQ ID NO: 402461 - DNA, 368 bp, Homo sapiens
aaataacatataatatcttctatatggttattcatatttttatcacacacacacacacacagtctgtatctcgagctcctctctggttatggagaagaggcagagcaccaggtgcataggctgagactgcagacacctgagcatcctatgctgtgaggcgaaagcatccggttttttcgggatgggcctgtccaggaaggttctcgaatgccacgtgattagaaaaatacaaaaattagccaggcgtgatagcactcgcctgtaatcccagccattcaggaggctgaggcgggagaatcacttgatgcagtgagccgagatcgtgccactgcactccaggctgggtgacaaagcaagaatctgtctca

SEQ ID NO: 402462 - DNA, 135 bp, Homo sapiens
acctctgcagataaaagtggagaaatacacacacagtatgaacagggcctagttcctgcccagaaaactcacaatcaagtggggaagaccaacatacacaaacttagctgtatgttacatgggaacctttgatat

SEQ ID NO: 402463 - DNA, 527 bp, Homo sapiens
agctctagagtacatgtgcacaatgtgcaggtttgttacataggtaaacatgtgccatattggtttgctgcacccatcaactcatcatttacattaggtatatctcctaatactatccctcccccaggctcccacccacctacaggccccggtgtgtaatgttccccgccctgtgtccatgtgttgcattgttcaactcccacctatgagtgagaacatgttgtatttggttttctgttcttgtgacagtttgctaaaaataatggtttccagcttcatccatgtccctgcaaaggacatgaactcattcttttttgtggctgcagtaaaaaggtattgaatactgatgtgtactacaacatgtataaatcttaacaccattttggtaaaaaaaatttttttaaaggatacaaatgtatacttggaagaaataaattctagtgttctataacgctgtaggatgactataatcaacaataatgtattgcatagtttcaaagagctagaagaaggatattaaatatacc

SEQ ID NO: 402464 - DNA, 312 bp, Homo sapiens
tatgctgctgaaatttaacagctgaagtactaacagtagctgaacttcaagccttgagtatcaattatttatgaacctaaaactgacaggactgtgtaggtgaattagctgcatatgtcaagctttgttataaatcccaacctactgtaaaactcattttcatagaatgtaggtacaaggctgacaatatatcaacagcacggcattaataatttagaagaatgagactgtcagggaacaccttgcaaactgtgctctgctccatagttgatattacaaataaaaaagtcaaataaaatgaatttcccataa

SEQ ID NO: 402465 - DNA, 780 bp, Homo sapiens
gtgttctctgtcatgaatttcttcttgaggggcctggagggagtcacagctgtgagccactaatgtgtgcccccatgcacacagcacccttggcataactaactccatcttagagactccattgtatatcttacagggcacttggccaacaaagaaggaaaggccccagcagaactcaccatctgccgcctgaggctccaccacctcgaagacatccttgcaagatccacagactggcccagaccaggaggtttctgtcttcttcttgtgtcttcttcactctcctggactggttcgtgaaccctttctcctatctctgtttcctctggatgttaaatgctactttctttgttgtggaacgttaacctgtaacatgtatatactgattaagtacactattacgttgtcgtgtgcaatattggctgacatgtgcagtggcttgagcccgtgtgaccgcagctctcactactgagggaaaggagcactaagcagcatgcctccttgggaacgccgtgtggctcgtggctttagggattgaaatagcctcaataaaattctgacattgtgaaagacacaggcatgcttggatgtgattatctctaactttgcactgctcatgacaccccatgtattggttaatgattttgcctgcaacttctgctttcctgaaatgtacccatacccctaaaaaccccagcttgtaagccactggggagtttgggtcttaagcgtgagctgtccgttctccttgcttgtccgagcgaataaatatcatctttc

SEQ ID NO: 402466 - DNA, 110 bp, Homo sapiens
gacgcaagcaagcgcactcttcagatgtcacttctcacgggaggcctctgtgattgcagaaggaaaggccccagcagaactcaccatctgccgcctgaggctccaccacc

SEQ ID NO: 402467 - DNA, 280 bp, Homo sapiens
actaactttaaacaggttcaaaggtaaataccatattttgttaattttcatattcattaaagatctaaatattgagaagtttgcttgaggattaagtatcttccaaccaggggcaccaaggtgaggacactttaaactagatatacctgggctacagcactgaaaagtagggcctatgagggtgggggattttgtgtcttgtttgttgctgtattcccagagcctggaacactgctgagtatataacaggcactaaataaatacttctaaatgaatgaat

SEQ ID NO: 402468 - DNA, 373 bp, Homo sapiens
tgaagaaccttcaaactgctcaccgagagtgaacacagtgtgcctcgtgggagatcgccaagcagcctggcagtccgtccaacgcagcccatttttctgccacaatttggccacgtgactccatcctcagtcagaccagatcaagcatcttcttgtatttagggcccatgttgcaaaaaacatttacacgtcgtcacacagcagggttagggtacatgtagcaagctgactaaaggacggagtcatggctctatgaaggcatcaaggtctggaggttggttttgtttgcttcgctgagtacgtagttaaatttgtgaacattagaggatccgtagtgccaccgcccagccctcccagagtgcttggtaggaat

SEQ ID NO: 402469 - DNA, 132 bp, Homo sapiens
taaataacttacatttctccaatgaggaagagtccgcatctctcagtatatttcacctaaaaaggtgtagccaaccaaacttttgtctattttatttaaaaaatttaaagaaatacagtacttaaaaacatt

SEQ ID NO: 402470 - DNA, 154 bp, Homo sapiens
gatgacagcaagaccatgtctaattactgatgggtagcgagggatatactggaggataacaaatgaccaccgacacagccataatgatgaaatgaaatatggtagaacatacaacactgccttaggatagactgaaatgttcccacactctttc

SEQ ID NO: 402471 - DNA, 379 bp, Homo sapiens
atggagaagaaataagatgaactgcttgtcccagaaagcgatagaactttgaaagcagctatatatttcctagctacctctaaaaaatggagctgtcttcatgagacctgtaagaagccaacagttttcctcactgccaccatgtgaagaaggatgtgtttgtttcccttccttcatgattatcaaatggaggttcccatgattttctttttcctcatggaaacatgtttggtcagaagggaaacaaaccaattaaggtgataccaaaggatgatccttgatacagttgtattttggtggagcgttgagattcgccagtgaactctaacagtgaggatggcactggaataaaaagagaagaaacatgtactagaagcca

SEQ ID NO: 402472 - DNA, 438 bp, Homo sapiens
gcctatatttggatcttttacaacaagaacatttacatcgattgcccttgtaattaaaaatcataaaatcgtaactgcttcttttgaaaaggcttgactgttagtcttcttcctaggtggcttctcataagcttggctgccttttgaaggatgaaaaacaaattactctctctattaaagtgctctccgaaaatttaacaaattgggcaattgctttgaggtgaacgagtcaccaggccaggttgcagacacccttggctaaggtcaatggccatgcatcagggaagtggtaccctaaaggagctggatttgtcccaggccagggtgccagcgggggacgggggtgtgttctgtgacatgagctcagaaacgtcttcccactatctttgatttcaacattctcctgcctcaggtgctggtgcagagaggagaaagaaa

SEQ ID NO: 402473 - DNA, 607 bp, Homo sapiens
ccactgggctcagccctggagctgagagcatcgctggagatagacgtggcagagaagaggttgcgagcatggccccagccagcagctcccacgctgcccctagtcctgggcatggagcgagccttggtgtcagagaccagggtgtgcagtctgagctcctctaccttactaaagagaggcctcttttatttaccagagccacagccctgctgcctcaggaccttttcattctgccggtgctggggctgtctatctgcaagctggaggtgttgagagcaggaaaaggaggctgtgaggaagggttcgggcagctcctcctgctctcagaggtggcctcctcctccaggcatggaggtctgtccactactgggcttctgggctatttgcccctgatttgctccctggtacgggctcttgttaacaggcaggcaaggggtgcggggaccaggcgagggcttcaaagggtacagtaccaaatcttccaaactcagcacttgtgccctggggtctccaaactgtcttctgccctaggatttattcatactgttaaattaccagtttatgcaaatgatatgtaaataaagctcaattttttgaaacttcaaaa

SEQ ID NO: 402474 - DNA, 400 bp, Homo sapiens
agaatttcacaaagcccctgactccgggacactgtgcagctctctggaaaaatgttttaaaggcaaaacaggatagaacgcatggccccccatgtctctcgcctgagtcactacattccatcaaagataaatgaccctagtcctcgcctttctctactcataaaataacacccgacaagaatagtgactatgtttctgtaatctataaccagatgtactctaacacccaaaccttgatgtaatttttcacatactaaatcttcaccacctatgtataaactaaaatactacgttggaggagtctgagagaacctttctaacagcctcctcccaggctacaggccttggtctataatcctcaagaagacttctaaataaaactaactttaattctttaaaa

SEQ ID NO: 402475 - DNA, 680 bp, Homo sapiens
ccgggttcaagcgattctcctgtctcagcctcgtgagtagatgggactaccgttgcacgccaccacacccagctaatttttgtatttttagtagagacgggatttcaccatgttggccaggctggtctcgaactcctgacctcaggtgatccacctgtcttggcctcccaaagtgctgggattacaggtgtgagccaccacgcccagccaaaccttcttttattagtgaactatcaattaactagaacttaattgtcacccagcaaataggcttgccggttaaaggtttaactgatttccatatactttcctatctttcaaaaaaaggtgaaagaaaattttttaagattttttaagttgcccattataatgttctatcaataacatttcatagatatctgcattttttgctttctgtgcacttcattttaaatagttaacttattttctgtcatcacagaaaatagtataaatgagtttaatagaaatccacaggtgccagtaaaagattagaagattgttcagactgctaaattgcaggctatttggaggtaaagtactccttgcacagtaattccacctcttcaaagcgtccttgttcgtgagaaatatttgccagcactgcactacttagagacaatgaagtatcttgtctacagcttgtcaaaagaggtaccaaa

SEQ ID NO: 402476 - DNA, 1021 bp, Homo sapiens
ttctctccctcttgggtcctttttcttttgaaccacacaggtgttctaccttcattctttttcttctctatttttttctggggcatctcatcctctttcacaacttgaattacaccttctggggttaaactatttctgtttggttctaatcccaacttctatgctataatcaggttacctgctaccaatttcctccaaatcccaccaactctctttgtataaaatagaattgataatcttacatacacatatacttgcctctcttccctgacttacccattcctttttaaaaacaggcacttcatctactcagccacctgggctggaaaccagtgttctctagttctgttcctttccattctctgcatatctggtcactcagttcagaatattctgtcttttaaaaaagtgcctgaaagttgggcaaggtggctcatacttgtagtcccacctactcagaaggctgagacaggaggatccttttgagcctaagagttcaaggctagagtgagctgtggttgcaccactacactctagcctggtgacagagcaagacactgtctcaaaaacaaaacaaaacttctgaagtgatctctccattcccattcactctattcatcattattgcattctgctacccagtctatttcctaaatatttttgctgccacttaattttatccttccaaaacatgcgatgggttttatctctcactactccctgtttaagaaaacagtgccggccgggcatggtgcctcatgcctgtaatcccagcactttgggatttggccgaggtgggtggatcatgaggtcaggagttcgagaccagcccaaccaacatggtgaaacctcatctcttaaaaatacaaaaattagccgggcgtggtggcagttgcctgtaatcccagctactcaggaggctgaggcaggagaactgcttgaacccaagaggtggaggttacagtgagccgatactgcaccactgcactccagcctgggtgacagagcaagactccgtctc

SEQ ID NO: 402477 - DNA, 754 bp, Homo sapiens
  misc_feature (496)..(496): n is a, c, g, or t
  misc_feature (688)..(688): n is a, c, g, or t
agagccttggccctccctgggagtctggtcggcgggctgtggggtcccaaaatcgtgaccccggcccctctcccctcctcccccaccatgtcccatgtcaggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtanatttgagcgggactgccgggaggcagagaaggcagcccagactgctgaacggctagaccaggatatcaacgccaccaaggctgatgtggagaaggccaaggcagcaagcccaccttcggagtcacatggccgaagaaagcaaaaacgaatatgcggctcaactgcagcgcttcaaccgagaccaagccccanttctatttttcacagatgccccagatattcgataagctccagacatgatgaacgcagggcacccgc

SEQ ID NO: 402478 - DNA, 744 bp, Homo sapiens
  misc_feature (17)..(17): n is a, c, g, or t
  misc_feature (42)..(42): n is a, c, g, or t
  misc_feature (486)..(486): n is a, c, g, or t
  misc_feature (678)..(678): n is a, c, g, or t
caaagaattcggcacgngggcggggaccgggtgcggtggtgnctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtanatttgagcgggactgccgggaggcagagaaggcagcccagactgctgaacggctagaccaggatatcaacgccaccaaggctgatgtggagaaggccaaggcagcaagcccaccttcggagtcacatggccgaagaaagcaaaaacgaatatgcggctcaactgcagcgcttcaaccgagaccaagccccanttctatttttcacagatgccccagatattcgataagctccagacatgatgaacgcagggcacccgc

SEQ ID NO: 402479 - DNA, 494 bp, Homo sapiens
  misc_feature (17)..(17): n is a, c, g, or t
  misc_feature (42)..(42): n is a, c, g, or t
caaagaattcggcacgngggcggggaccgggtgcggtggtgnctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagctgtgccttctaccatcgttccaccattgatgtacatactcatgttttacatcttttcttctgccgctcggctccggccattttgttttatacaaaaatggga

SEQ ID NO: 402480 - DNA, 423 bp, Homo sapiens
aggtgtacagtttagtggcattaagtacattcacattgttgcacaactatcaccaccatccatctccagaaccgttgcatcttctcaaacagaaactctgtacgcattaagcaataactccccattcccttcttccccagcccctggcaaccatcattctactttctgtctctatgcatttgactgctctcagttcttatatgagtggaatcatacagaatgtgtccttttgtgtccggcttatttcacttagcataatatcctcaaggttcatccttctagttcattcttacaataaaggaagtacaacttgtgaattgggaaaaagcagattggatattttttagtcacaaaacatatttattgtcagaagtgaagcaaacaaagttgttcaaagacaaagctaaatatttgtcgaacttc

SEQ ID NO: 402481 - DNA, 409 bp, Homo sapiens
aaggtagaggttggctgttgacgactccagatatgtttggtctcatcacattggttctagataactaatatttttaaaggatgactaatagactcataggagtctctagaatgaaagcatctgtctgtccttatcatgtttgttttatcatccaaataagccctggacgcagtggccaaggccccagttgaagtctcaaccctgctcttgactagcagtgtgaatgtggccaagccatgaactccctagcctcaggatccctgtggtaaagtggggttaacagtatctgcccatttcacaaaattgtcattgaaggcaaatgagatcattttaaaaaggactttgaaaaactatgaagtgctgtatagataaataaaatagcagttttatttattatgccgtgttcaaa

SEQ ID NO: 402482 - DNA, 1527 bp, Homo sapiens
ctgggtaaatactatggaaccttcagagcccattctgttttagtgaaatcatgtttatattgaagtcgaatctgagttctggagtgtcatttccaacaacatgaacctctgtccatggtgaaaatattctgaacaaaactgaaattgttacataactcatgccttttgtctttaacccaaatttcttattcccactatatagaaaatcaatatgaatttgtttcagaagagtgattatatcttttcatgagtatacctgtatttctagattaaagagattgtgtggctttgttctacagaaggtttgattttgtctcacctttcagtgaggaaagagaaaagaaagacacttcagattttaccctaaggaaatatactgttggcgctccatcatctaatacctttatgaggggcatactgtgggttaggaactctctctctgcagggcttaggaggaaagttgttgccacctgccaccgctggccgcctgaggtttctgatagtcatgtgtaagttttgaatggcagaacaaagcatgaatcagacacacatcttgcctagccatcccctgtgtgcaaatgtgtatgatgtggttaaccatgtaaaaatgcaccccaaaaggagcattgaatcaatttgtattttcttggcttttaccttaaacttgtatataaggattatttatatattgacagaaaggaacatgttgatctgaatatcactcatatatccaagaaaagagtcagaaatgtattgttgtgttatagattgatctaaatacgtattaattatcttcaagtgtagacacctagatttaaactgactctgtggcagattaattaatagcaataagccaatgaatagggaagatttttaatatataatgactaccagcttgttcttggcttacattcttgagattattgtattcaaaagtgtcagttggcttcacattttggcaaagagccttctgcattcttattctccttgaagcataatgcagataatgacaacttatctttctagattagtcttttattattcaacaagacaaaggccacaacaaaggactagtagaaatagtgacctctaccctgagaaatttgttataactatagatgtttgtgctctgcccaagagattctgatatactgtgatttgatgtgagcccacgatgtgaattattataaagttctctagttgattctgatacacataaaagttgaaaaattggccatgtgtggtgtctcacgcctgtaatcccagcactttgggagtccaagatggacagatcactggagcctaggagttccagaccagtctaggcaacatggtgaaaccccatctatctttataaaaaatataaaagttagccaagtgtggtggtgcacacctgtagtctcagctacttgggaggctgaaatgtgagggtcacttgagcccaagagatcgaggctgcagtgagccatgatcacaccactgcactccagcctgggtgacagagcaaaaccctgtttaaaaaaaaaa

SEQ ID NO: 402483 - DNA, 920 bp, Homo sapiens
taacctttcaagagagaacttctgattccatattcctcaatttttatctcattacatggagccaccgtctactttattgcttaaatcaagaacctaaacaacattgttcaatttctccttttcccttaccctctgtgtccaactgatcatcatgccttgtcaggttaacataactcttttcatctctgttacaacctctaccccagtccagttcatcctctctgttgcctggacaatgttaaagctcatgacctatctcagtaatcacgctggcgcccccagcagtccatccacaaaatagcacagtgaggctttaaagacaaatccttttttgtcacttccctctcataaacccctttgtttaagtcaatcaaattatctgtcatcttctgtctgccaaagctgtcggagcagatcaaggtggtaattggcatcaaaattcttcataaaatgtggtcactcatcattttttcttttctctgatatttgttattcttcaattaaattagtcatgtatttttttgtttggaaaaccttttctacccattatttcaaatttatagaaaactaattcattttttaaaatatgttgagcacattcatttttgcaaggctttgggggttacaaggaacatgggtttattggttattggttagtttatggatacaattcatgataaatttctttaaaaatcaaaaaatagaaaaactgagatagcacatggctatatatgattgatcaccccaaaaataagcagcatgaatttataaaagcaagaccagtatgcgtgagagttcttagaaaagcctgcactcaggagaatcgcttgaaccagggagttggaggttgcagtgagccaagatcacgccacagcactgaagcctagcgacagagcgaaactccagctcaaaaaaaaaaa

SEQ ID NO: 402484 - DNA, 695 bp, Homo sapiens
gagatttttataccattatttatggctttgctttcctttcaaggtaagtcttattttcttgttttcattcttacatttataagactctcctgcctccagttgtgagcagctttataccagtcatggttttcccttaagaaacctgccagccatttcacatgaaagatttttgcttgaaaagtgcatatataaattatttttattattactctaaaaaggtgacaaatgttaactgatatgtacagctaaggcggtgtggagatggagatgaacaatgcacttaatgacattgcaaaatcatgatgttaaaaacattttgctatttcaaaaatttctttttaaagagaaactagcaaacctttcagacagcactagcaaataacgtactattttaaattatgtattatttcctaagaaatttaaaaagaagcttgagatccataaatgcaagcactgacttacttataagtacacgtttgggaaaatgctgctgtaaaactaacgagttatcttggcttcatttaacaaatttaagtgaacacttttaccagtccacattataattctattgtgatcttaaaaaattagcccctagaactattttaatgtgtcggctgggctgactagcccactgtatgcatcctgttaacttctctactgcacgccggcatactttcctcagttctcggccgccc

SEQ ID NO: 402485 - DNA, 208 bp, Homo sapiens
aattctacagacatttattttaatttattttccctcgttctggagaccaagcagtccaaaccaaggtgctgactgatttcgttgctgttgaaggccgtcttcctgccttgcagatgggcttttttttttttcttctgtgtcctcacgtggaagagagagagagagatcgagagagtgcactctggtatctcttcctttttggggggag

SEQ ID NO: 402486 - DNA, 410 bp, Homo sapiens
aatgcacattcacaccacgagacagggcaaaggctaggtcccttcccggcagggggatgcgccagcctcgggcttcctggaattctcatctgcctgaccagctgatggcagagtcatggtgactcaggactgaatattcagctgcgatgttcgatgctaggtgtggtgcacgtcacaggtgagcaaaaccaaaggaactggaaaagcttcacatttgagtttaccattgacactgagttgttttacagggaggagcctgaggtgcagacggtatcagctacaggccaggttgtgtctctaagccagatgagtgtcctcatccttaaggagtcatcttcctctaatcctctggttctcatccccatctcagctgcttttgaaaattaaatattatgccaaggcacctcctg

SEQ ID NO: 402487 - DNA, 261 bp, Homo sapiens
tttctgtccagtatagattccctgatgtctaatgcggtgtgaatgtaaagtaaagacattgccacactgggcgtggtggctcatgcctgtaataccagcactttgggaggccgaggcaggcggatcacaagatcaagagttgagagcaaccaggccaacatggtgaaaccctgtctctactaaaaacataaaaattagccaggcttggtggagcatgcttgtagtcccagctactcaggaggctaggaaggagaatcgtat

SEQ ID NO: 402488 - DNA, 438 bp, Homo sapiens
atatagggatgtgtttatagctactgtgcaattgtgtgcatgagtatgtgatgacctagaggttaatcagaagctgttggatgatctcagatctgttcttaatgaactccaaggggtattctaattctgatttagcagtctgcagttattcaaagtggactgtcaggaagctaagaattgcaggctaaagtaatgcccatttctccctgagccaccctcatacctaagaatctttcagcttctaacagtgttctttccaagccatcatggtacattagattgtacagaatttctctagtttgtctaatatttaaagtagaccagttatggctttgatagcttgattttgcagatggtccacgtttgaactttttgtacagaggtttttcagttgagtccgctgaaaataggtaaacaaaaggaacagtatatttaaaa

SEQ ID NO: 402489 - DNA, 490 bp, Homo sapiens
tgctaatattttattatttcaactctagaagatcatgtactcaaccactgatttattcatgaatctatctatttatcctttcaacattccttcactatcgactaggatgatactgtagttcatcaataagaatatataggttttggagagagattgacacctaaatttcaaactcagcttcaccacttactaactgtgttgagctaggtaaacacagcctctctgccccttagtcagatgtaagcatgataataatgtttacagttaaggattattgtgaaaattagtgataatgtacatcaaacacttggtgtgctgtaaccattcaacagatgataatggagactctggttgttatttgccagaaatcaggatgcgaagatggaaaacacataactcctccctctaaataactgaagtggaagcaaatgactacagtgtagattagagttaccaataagctatggatcagagagaagagaatgattta

SEQ ID NO: 402490 - DNA, 198 bp, Homo sapiens
tacagttgacccagagtagtgtgtattcagcactgacttcagatctcactatgggcgtgtgtactatcctcagacaggcctctggcagtagggcaggagcactgtacccagatgtgattggccgatgtcatgtgtgtttcctgagctcccctaggctgtctctatgaatacgggagcctctgtgggtctgaaggggcc

SEQ ID NO: 402491 - DNA, 479 bp, Homo sapiens
catataaccgggttcaaaaatgactgaaaaggggcaaaggagagacttgtgtggggagaaaaattatttgagggtaaaagataaaaattattttgaccatcattaatttgatggtaattgttttaaatttctggttttagttgtctctccctttaatgctgtattaaccacactgccttccattgtcctgtgagaatatgtttatttgctgggattttaaatagtcgattctattgtggattagtttatcttttagttacttcattgtgacagtgttttatccagttctgtgtcacttcttgttaatcttttaatagatttgctcctttttatgcctgtttttcatgctcctttgatgagtggattggggtgagaaggtcaaacccactattttttattcattactgttgtgaaggctcttcaagagagaaagatgaagctgaaacctttattaaattttgctaatgtggacttgtttt

SEQ ID NO: 402492 - DNA, 322 bp, Homo sapiens
tgcatttggcaggatctctctttttcatcttttgttttgtggaaagatgcaaaccccaagtaactgcccagtttgcatcgttctaggcaccgtgcatggaggaaaaactctggaaatcactacagaggacccttacatgcaaactgcaaaattaaggtggccttcaagtgtcaacaggctctacaggtgatgacagaactaataatcaccactgctccaacacaagagcctatgcagccaggtactagacttgcactctttctaatcttcgtaccaaccatgtgcaaatggtgttcattatgcctgtttacagatgagaaaa

SEQ ID NO: 402493 - DNA, 344 bp, Homo sapiens
ggaattatattaaaaatcatgtagttaattaagaatgattgtgagcttagacactgaaaaatatgtcactgaaagaataccaaaaatgtcagccttttcctcttaagttatagaaaggtatataatataagtacttagtacataagagaagagttagaatgagattgtaccaggttcagaattcctcatccgagaagaccagacaaaattcaagatttttagagagggactccctgaatgatgtcaccagtaagtgggtttataaacaaagacagagcttggcaggttgcactggatacttcaaaccagtttctctggaaaaatttgagttactcaataaaccc

SEQ ID NO: 402494 - DNA, 167 bp, Homo sapiens
ttaaggaaaaatttgaaaagaatttttttcatcttttaagacacaataaaaaaactaactgcaaaaaagcaaaaccaaaagaggcatcatttctcttaatgaaaattgactaaaaacatcatcctttgctagtttttaattaacctataagtcactttttttttttt

SEQ ID NO: 402495 - DNA, 312 bp, Homo sapiens
cccctgccacccagggcagcccgggctcaccatgccacagggcagcttccctcagctcccgtcccctcatgcccaaggtggtgctgtagctggaaggcagcatttaacccaagagccctgggacaggccacagggccccggacttttgagtaaaaagaatctgtggccagttgctggccgtgtgaccctgagcaaatctcaatcactctgcaccatattttgttcatctattacaatcccagacatttactgtgaatatggggtgagataatggatgtgatgaagctttgtaaactgccaggtggtggtttt

SEQ ID NO: 402496 - DNA, 338 bp, Homo sapiens
attgttgcaaaaattaacctttgccgattaaaatagtgttaagtatcgggttctggatgctatgctagaacaaaggcctggttttataggatcagaaatgactaagtaaaggggattccttccagagtgacttgggaaataaagaaattcttctttaagtatttaatcaataaatagagaagtgaaagcctatatgtgtcttagaaagatgaggtttcttcttattatttctacttctcctgcctccctgtttgaatgtgttacagtgatcgtgattggattaattcaaaataatgcttatttaaatgataagatgttgcttgctaatgttacataaa

SEQ ID NO: 402497 - DNA, 558 bp, Homo sapiens
attgtttttattttattttattcagatgcctgtgagaattttaacacatatcattccaaagttcattaccttaaaagtgatatctagtgacatctaacttttatctttcacaaatgtatttgacagtgtttgttcaagttagaaataaaagtttgttttaaatgaataaattgaaacatggggagatttttcaataaataattctgactcaaatctctcttttacctctttgttttggcccaccataccttcattgaaaggtattactttccaccatttagtaagactgttttaaattcttttactgcagccaaaagtcaattaaaatgtcaagtttaaaaccatttttgcaaagagagagatggggctcaagtctttagagctgtactgtctactaccttagtcactagtaacgttgtggctgctgagcacttgtaatatggctagtctgtttgatatgtgctgtaagtgtgaaaataatattgcatatcttactaatgattttcatactgattacatgttgagatgataatacttgaattaaaatgaaatattaaa

SEQ ID NO: 402498 - DNA, 718 bp, Homo sapiens
ctggtcttgaactcctgacctccagtgatccacctgcctcagcctcccgaagtgctgggatacaggcatgagccactgtgcctggccctagatatgtttagatacacaaatacttaccattgtgttacaactgcctacagcattcagtatagtgacatgtttgtagcctaggagccataggctataccatatagcctaggtatataggtatataggtataataggctgtaccatctaggtttatgtaagcacactgcatgatgttcacacaatgatgaaatcgcctgatgacacaatgtcagaacatattcctgtctttaaagtgacgtgcgaccgtaagtaaatctgtatacaaagtatatttgtatattacgttcttgtgactgtactaaactcttatgatttctagtacttttataggttctacagtattttctacactcaagatcatgtgtacaaataaacactgtcttgctctttactctcctacatacgtctttttccctgcttaccttattcactgactagtacctccagtgcaatgtcgaacacaagtgaggagagaatatctatgccttggttctcaatcttaagaggaaagtatttagtccatcactattatgtatgatattagctgtaggatttttgtattatagcagaacttcataaggccaagcaaagttcccttgtttgctgacagtttttatcataaatgagt

SEQ ID NO: 402499 - DNA, 412 bp, Homo sapiens
cagccatgtgtccagccacccctacaagctgggcccccaatggaggggcgtggccggcccacagagaccagagccacacaaactgacccacccccccccaggcctacccctgcctgtgccccctgctgatgggcttttgggggacccaggggcacggagccctcagtactgcccaaggagtgagagaggcagatggatgcaccagcaacatcagggaattggacttaccccaaaaacattgccaactcctgcaccaaacccaaaccagaagatagcgcctaagaaagggatgtcttcccagaagtgatcttgtttatataagactctcccagagccatcaaaactaaatcatgttcacttaaatgtttaataatttcccttcaccaaaaattaaaaaattatgtgaaaccct

SEQ ID NO: 402500 - DNA, 1003 bp, Homo sapiens
gtttttactcatgaattggatgtaagaattgaggagaaacgaagaaccaagtaaaaattttgagctttggcttgggaaactaggtatatggtaacgccaaaaagagagatgtagagaattgatgtaggagcaaagctgggctgggaaattgagaaaattatacctgccttgttaaagttgaaacacccacatgacactcacctggaaggatattcacacttggattgttggggaataataagaactagagatacagtttgagggtcactggcatagagatagtaattaaaaccaggatgtcagttatatcacctagggataatgcaaagagagagaaaagcaggagataagacagatcgagcagtgggagaagccggcattgaagaatgaagaggaaaaccaggcgtgtctagtgccatgatgccaagagaaaaacccagctccgagaagacaggagtttgtttgctaatgttattgagggataaagtaaaatacgaagagagaagtaacttggactggcggcaaagcgatcaccagtgctccttctaactgtggtgtcgataaagtaatgtggactggatgaaggagcctcgttggaataaactcatataggaatgatgataccgtgtttacctactaatgggaatgaccctattgaagagggaacatcacgtatgttggggagcggaaaagtcaaagtcctcgaaaagatggaattctgctcctggaaccagccaccatgctatgcagagctgaatccatgtagaaagctagcaagaggattcaaggagccctggctgacagctgagctgagctctgtcctgtagccagcactgacagccagctatgtaattgagccatcacagacattaccgtctcattgtgccttcggaagatgacagccccagtcaataccacacagagcggaagaactacccagctgagaccagtcctacaccgaattgtgaaagatgataaatggtcattgttctcagctattaca

SEQ ID NO: 402501 - DNA, 345 bp, Homo sapiens
atgagtcttgaagggacagataagaatacctctcaccagggtttatcattattggttcacatctgtcatattcagtagaatatgtattttttaaagaaattaggtttgttttgtataaagattagatgtatacaataaaaatattaagtaataataaaaatcacgaaataaaaaggaagagaatccctctacctctacactatgaatcttgcttcccagaggtaaccaccattaatattttttgggtagggattcttctgtgtgcatgtaggcataggaaaatgatcactcttgtaatatcgatttttaaggctaaaaaccagataaatacataatactgtgata

SEQ ID NO: 402502 - DNA, 381 bp, Homo sapiens
gaacttagtttgtcttgcaggctgtgatttagtacagttcatctattttgtgaaccatagtactcttttgtaagtaatggcttttattttaagtatcaatttccccattttgaccagctgcaaacaggaatatttatttatttttaaaacaacttcattgaggtgaaattgatatataacaactgcacatatttattatatacaatttgataggtttcaatgtatgcatatacttataaaatcatcaccacaatcaatgcaatagatatatccacccctccagaagtttccttgtacctctttgtttattttgtagcaacatataacatgagatctagcctcttaacaaatttttaagtgtatgatactgaaactttatac

SEQ ID NO: 402503 - DNA, 328 bp, Homo sapiens
ctcatacgaagggaggggacccaaaggcagttgcctggaaatggattttaaatatgaggtctgtgggtgaatagtgcaatattgaacaaaggaattttttttttcagatataagaggtttattaaggaaaggctcacagacacacccataaataatgggaggaggatggggaaagggatgaagcccagcaagagtgtgatttcatgtaagtcccagcattggcctgactgccaggggagggacctatggagtataaattatgcctcagagtgtgtgcctccttgtgaagggagctgggcttttgactcctaaccctgtcagtccatgg

SEQ ID NO: 402504 - DNA, 363 bp, Homo sapiens
atttacaacttgatcattcacttgtatgtaaccagtctcctgacataatggctgtcacctcacctcagcattctgtcagggaatttctggatatagtttttcagtgtacataaatgtctgaaaaattgattccaaggagaaagatcaacttccttttagtagcaacacttgtttttcatgttaccatatgagattaattttaattaagcattcgttttctgttaaatttgagatctcattccttaaaagaatggattgattgagagaaacaagtaattttggaatgggtaaattttttgggcaagggctatgtgggtttattcttctaggtagatgtttacagagggattatctaagggtaca

SEQ ID NO: 402505 - DNA, 518 bp, Homo sapiens
ctgcttggagattcttgacactgcctgcccctctgacatcgctgccctgagatggctctatagagccagaggactggacaggacctgcctcccgctcgtttggttccggcctcaggcttaggacaatggggtgttcctagcacccgagcgggcctcctggtcacagtgcgccttttaggtggctctcccagcgtcttcactgactttcgtgaaatagtgtcctgcgccctagtgaaactaccctgccttcacttaggcccgttttcttgaggagtgaagctgtcggccgctgtggcccctcctgtgccgcaggcgcatgcgaaacagggaccgaacgagccccgcctcgacgcctccaatcccactgatccccctgcctcggccctcgttccgagaacgaccgttccattcattcagtcttggcagtagttatttgattcgtcttctcttgtagtatactttaaagtgtgggcgatgcagttggctgtggtgctttaataaagatctgatcgatgcgg

SEQ ID NO: 402506 - DNA, 254 bp, Homo sapiens
aactgtaagactactcaggaaagtctatagcctttatttttaatccaagtgtctgccctgaatttattccttttctatcctagtgaactcaactggaagaactagacaaaaacatgaatgtcggcttgaagaagccttgtcaaacatagagaacattctgcctgttccttgcactccctcttttgagtcctaccctggcccctcttatctctccaaaatcaaaaacaccccttgggcagaacaacttcaatact

SEQ ID NO: 402507 - DNA, 441 bp, Homo sapiens
ctcggtgaggtgaactttaaggtgtatatctcactgtctactcagcctgggaggagagagagcctgaggcaaggatatatatcctaatttattggcagtgggaaaaaaatggttcggctgaattattagggccttggaaaaaagtagaggatggctaacgagatttggaaaagaggtatgtgaaaaacttccaaaattactgtttggactatagagtttgactacagttggcctaatgttaatgttcacccaaagagtcccatggtcaaggaggctcttggtcaagtggggaagacacctgctctgtgaaggtcagctagcctttctctgtagccgctccatgacttggtcaagggacttatgaatagagtggccacagcgacaaagatggagttaatgtattagtcaacacagataccctcctcactggcgcatgccata

SEQ ID NO: 402508 - DNA, 381 bp, Homo sapiens
cagcaggcaggggggcacccgcgccctcgcctccccagccgaccctgccattgtctccctgcgagcttcagagaggacggaggcctacgcccgggctggccggcctgctggagggaacagggaatggggcccaagcccctgttctgtgtggacccaaagggaaagcatttgggtgaggctagtccaaggggaggcagtgaggtcagtgcataaggggcagggatcccgaggacacaaaagcctggggctgaggccttacggggcctcaggcaagccacccattcggagtctcggtgctctcatctgaaaaagggatcacaaagagtccctgtgaggagtaaattagggggtgcatgtaatgcacctggcaggtgcaaagtg

SEQ ID NO: 402509 - DNA, 178 bp, Homo sapiens
gtatcgtacgtgcggccagccgagccggcgtttctggcccgcttcaaggaacgggtcggctacagggagggacccaccgtagagactaagagaattcagcctcagcccccagatgaagatggggatcacagtgacaaagaagatgaacagcctcaagtggtggttttaaaaaagggag

SEQ ID NO: 402510 - DNA, 2618 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402511 - DNA, 1172 bp, Homo sapiens
ggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatgggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggtctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaactgaccccaacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttaaatgctttacttgaaagttttta

SEQ ID NO: 402512 - DNA, 2092 bp, Homo sapiens
  misc_feature (1428)..(1428): n is a, c, g, or t
gagatggggtttccccatgttacccgggatggtcttgaactcctgggcttaagtgatcctcctgccttggccttccaaagcattgggattacagacttgagccactatacccagtctagatgagccactttttaaaagtgcaagtctaaggacattttgagtttgcatatggtactttaaaagaagcattttgctgtgaaagatgcagagaagctgtggtcttttctcctgggcactaaatagagtgagacataggactccccggttacccaagcaagatgaaggcaaggtccctagagcccccagtgtcacagaggcgttggagggggctttgcttgtgcttcctgttgctggttgaccgatgtgctgatcgtttgtccttgcatgtccgtgtccgggttgcagcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagngtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacga

SEQ ID NO: 402513 - DNA, 1688 bp, Homo sapiens
gtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggccgaggcgggtggatcacttgaggccaggagttcgagaccagcctggccaacatggcgaaaactcgtctgtgcgaaaaaaacaaaaatcagccaggcatggtcgtgcgcgcctgtaatcccagttactcaggaggctgaggcagggaattgcttgaacccagtaggtggaggctgcattgagccaagatcatgccactgcactccagcctgggtgacagagccagaatctgtctcaaattacactagtaagacaactagaatatgccaaaaataaataaacttaagcactaaattatctgagatcctactgtatacagataataacgatgactgcatatttttaaactgtgaacacattatcctattaatcctgctcaggtaacccacctttgtaatgtgaatattctttcccagtaatataaagaggtagacagtttcttaagctgttagaatgcagtgaatcctcccaggccctgaagtccagttgaatggaaatctgcctgggccagggcagccgccggccttccccctggttctcacagccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaa

SEQ ID NO: 402514 - DNA, 945 bp, Homo sapiens
ggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatgggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggtctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccacggcctgcagccccaggaagcaggcagctgggccagggagggactttgcacatgcagggactggggggagctggggatgggcaagtggtgactgctgctagctgccaggctgggcctccaagaggggctt

SEQ ID NO: 402515 - DNA, 3220 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtaggcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402516 - DNA, 2761 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgaaaaaaaaaaaacaaaaattttggggccccgccccaaaagtttaaccatttggggcgcgcccagtaggacctgccattccagaccggctcgatggggttcccaaaaaccgggcggtcaaaccggtgggccggcacacgaccgtt

SEQ ID NO: 402517 - DNA, 2540 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402518 - DNA, 2692 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagcgaagtatctcagaaatacctaagaaaatcttaagtgctaatgggtcaaaccattttcccctgcctggctcacaggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402519 - DNA, 2617 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaaggcgtctctggccgagcctctttttgtggaaaacgacagcagcagcagtggcctggaagacgccaccgctaactgaccccaacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttaaatgctttacttgaaagttttta

SEQ ID NO: 402520 - DNA, 2392 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaggcgtctctggccgagcctctttttgtggaaaacgacagcagcagcagtggcctggaagacgccaccgctaactgaccccaacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttaaatgctttacttgaaagttttta

SEQ ID NO: 402521 - DNA, 2262 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaa

SEQ ID NO: 402522 - DNA, 2289 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaa

SEQ ID NO: 402523 - DNA, 3032 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccgggtaactatctcttccagctctcccgactccctgcacgccggctgctgggccgcttctcttcctagcgcagccttcctcacccacagacttgaggaaagacactccagttggttcccgtattctcacaaccgaagggtttcatagttgccacgtaggtttttcccaggataggttgagaagtaattgggtaacttcctgttagtggctaaagggcgaatacctttaaaagaaatttatggaattttttgattctgtcacatgttctaagaaagccttagcaacgaaatgtgggcatttatattaaaatgttgagcattttgaacttgtttactctagatatgcattattttttaaattagcattagtttaaattctttaaaaattttaatcttttaaataaatcagatgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttagagactgattcctagtaaaactattttacaagtgatcccactttaagttctgtgagtaagaagtctgatcacctcaggatggtgaaaccgagttcttctggagaacatattggaaataataaagttatgtgcctgaaaagtt

SEQ ID NO: 402524 - DNA, 3797 bp, Homo sapiens
  misc_feature (3133)..(3133): n is a, c, g, or t
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagngtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacga

SEQ ID NO: 402525 - DNA, 3845 bp, Homo sapiens
  misc_feature (3133)..(3133): n is a, c, g, or t
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagngtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgataggcatttagtgatctatggcagtaaagcctgaagcttagcggacac

SEQ ID NO: 402526 - DNA, 2242 bp, Homo sapiens
  misc_feature (2049)..(2049): n is a, c, g, or t
  misc_feature (2142)..(2142): n is a, c, g, or t
  misc_feature (2144)..(2144): n is a, c, g, or t
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggggcggcgattgaatacctgcagtcctttatggtaaaagagggaagtacaaagaagcagagccgttgtgtnaaagagctctggaaatccgagaaaaggttttggggaaggatcaccccgatgttgccaagcagttaaataacttggccttactgtgccagaccngngcaagtatgaagaagtagaatattattatcaaagagccctcgagatctaccagacaaaactgggacctgatgaccccaacgtggcacgtggcgtctgt

SEQ ID NO: 402527 - DNA, 2772 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaaggcgtctctggccgagcctctttttgtggaaaacgacagcagcagcagtggcctggaagacgccaccgctaacgacccgactgaccgtccaggatgggactgcgagtgtggccgagctggcccggaagcaaggcggaggaggcctggcggaacgaggctcacaatctcctgcgtcgttgctagatgttaatacacacgtgcggactgggcgggtgacagtgggcggggggcaccaaaacgggtaaggccagctccaggaacacactggcaagtagcttaaagttccaaaaaactcgtcgggaaaaaaaaatacttaagcgcaataaaagagaagagagagaaaaaagaaaaaaaggggggggggggggggtgaaaaggaatcacgagaagggaggacaagagactaagagccaccacaccaaatccacagggaggaagaggggcgcgcaaacagaggaggagcgcggaagaaaacaggaaaagagaggagcgggggaggcagagaagaaaaaagcgaagagcagggagagaaaagcgcccagacaacgaaagaatggaggggaagacacgcaaaacacgcgggggggaggacaaagtacgtagggcgcaagcgccaacgaca

SEQ ID NO: 402528 - DNA, 2395 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggggcgtctctggccgagcctctttttgtggaaaacgacagcagcagcagtggcctggaagacgccaccgctaactgaccccaacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttaaatgctttacttgaaagttttta

SEQ ID NO: 402529 - DNA, 1720 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttttagagtggttgtaacagttggactatcaacttctagatcgcgagcggccgct

SEQ ID NO: 402530 - DNA, 2619 bp, Homo sapiens
gtggtcccatcctctgtaaagacacacagagccacatcacacatcctctatcctaggtggagcccggggtctgcctcccagctgcaccacctttgtctgtctgcaggtcgccagctctgctggggccttctgaagcagcctctctccgtcttgccattcttttcacactgctcccatgttaagatttctacacgtttcgaagacactaaattcttacctaggattattggggaatggaatatatggttagaaatagatgaatttttatttttaaaaaatgacaataagggctggacgaggtggctcatgcctgtaatcccaggactttgggaggccgaggcgggtggatcacttgaggccaggagttcgagaccagcctggccaacatggcgaaaactcgtctgtgcgaaaaaaacaaaaatcagccaggcatggtcgtgcgcgcctgtaatcccagttactcaggaggctgaggcagggaattgcttgaacccagtaggtggaggctgcattgagccaagatcatgccactgcactccagcctgggtgacagagccagaatctgtctcaaattacactagtaagacaactagaatatgccaaaaataaataaacttaagcactaaattatctgagatcctactgtatacagataataacgatgactgcatatttttaaactgtgaacacattatcctattaatcctgctcaggtaacccacctttgtaatgtgaatattctttcccagtaatataaagaggtagacagtttcttaagctgttagaatgcagtgaatcctcccaggccctgaagtccagttgaatggaaatctgcctgggccagggcagccgccggccttccccctggttctcacagccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtaggcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402531 - DNA, 839 bp, Homo sapiens
ggtgactctacaggatccttagtgtcatgtataccatgatcatccgacgtctactcagatgaaagtgggaacatggatttgacaacttcatcagctgcttggtcaggctggacgccatgttccgtgccttcaaatctcttgacaaagatggcactggacaaatccaggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402532 - DNA, 749 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaatttttgtctggcttgacaagataacaaagccaggttgagtgggaagaaaattttgccaaaagaacacaagcagatttatgacagtgggaagatgctttattgaagtgaatcccatgctgtgatagaaattttctgtgaggatttaattcaaactcgatcctttttcaagtatataactatttaaaaagagaaattaagtgaattgtcagctgttggccatctgcctcaatgtgtgcttttgaagcccagcagattgcac

SEQ ID NO: 402533 - DNA, 231 bp, Homo sapiens
agcagttcagattttggagttttggattaaggatgctcaacctgtatgctgtgttttcttccctagatgaaaataaacccatctggatgcatgctgaagaaagagaagaatgcaaagtaagaatttattattttgagattttctaaattgtatatactgcattcaagataattattcatttgaaattatttcttataatttagggaaagcaaaaggatgggacatcttttg

SEQ ID NO: 402534 - DNA, 563 bp, Homo sapiens
catgggtcacaggcctttaaagctgggaggtttcaaactgctcccagggatcctgccccagagccgattgtggtggtgaggaatctagcccctccacttctctggggatcagagatgcaccattttcacctgttgctacatatttggttcccaaataagattttattttgagtcagggttttccctgctctcctagacctccctcaaagcgcgggagaaggatctgaggcatgaaatgcagccatggcccatttcgtcaaactgtggtctgcactcaagtatttgtattctagtctaaaaagcttttcattactcctgttcaactgatggataagccagattgtcggcgatcctacatttgatgttaaaaactgatcatcttttctaagattcttagttaaaatgtatttaatattaaaaattttcaggacaggatgtgtatagcacgtgtaagatgaagtgttgtcctgggtctgttttataggaggacaaagacactgattctaccaaagagcctctggatgaccttttccccaatgatgaagacgacccagggcaaggaa

SEQ ID NO: 402535 - DNA, 482 bp, Homo sapiens
ccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgacctgtgtcttggtgtctgtctgcttggtagaacttctcactctttatccatgaaacgccgcatggcacagctgctaggggtcatggggtgacagttcatctcaccaaggagttccttccaagaagaaatgctgctgtatgcacatcttcttcactctgtgttttttattttcatgttcagatactgccaagtatttcacttattaatacctgaatcaattaagatgagagctgggcactctcacctccctacaaggttgtctgaggatttttagttatttgtata

SEQ ID NO: 402536 - DNA, 2419 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggggcgtctctggccgagcctctttttgtggaaaacgacagcagcagcagtggcctggaagacgccaccgctaactgaccccaacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttaaatgctttacttgaaagttttta

SEQ ID NO: 402537 - DNA, 469 bp, Homo sapiens
gacttggggtgggggttccccagagagctgtttccagaacagaacttagtaacactgtcaggttttggcggcccagccctgaccttctatcttctcttgcagtgaccccaacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttaaatgctttacttgaaagttttta

SEQ ID NO: 402538 - DNA, 2591 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402539 - DNA, 2734 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgaaaaaaaaaaaacaaaaattttggggccccgccccaaaagtttaaccatttggggcgcgcccagtaggacctgccattccagaccggctcgatggggttcccaaaaaccgggcggtcaaaccggtgggccggcacacgaccgtt

SEQ ID NO: 402540 - DNA, 2594 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402541 - DNA, 2665 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagcgaagtatctcagaaatacctaagaaaatcttaagtgctaatgggtcaaaccattttcccctgcctggctcacaggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402542 - DNA, 3169 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtaggcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402543 - DNA, 2562 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaatagaagaagctgctatgaggtctcgtaaacggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402544 - DNA, 2626 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaaaaagaaaaaaaaaagaaaaaaaacaaaagaaaaagaaaaaaaaaaaaagaagagaaagaagaaaaaaaaagagaagagagagaaaaaagaaaaaaaggggggggggggggggtgaaaaggaatcacgagaagggaggacaagagactaagagccaccacaccaaatccacagggaggaagaggggcgcgcaaacagaggaggagcgcggaagaaaacaggaaaagagaggagcgggggaggcagagaagaaaaaagcgaagagcagggagagaaaagcgcccagacaacgaaagaatggaggggaagacacgcaaaacacgcgggggggaggacaaagtacgtagggcgcaagcgccaacgaca

SEQ ID NO: 402545 - DNA, 3035 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccgggtaactatctcttccagctctcccgactccctgcacgccggctgctgggccgcttctcttcctagcgcagccttcctcacccacagacttgaggaaagacactccagttggttcccgtattctcacaaccgaagggtttcatagttgccacgtaggtttttcccaggataggttgagaagtaattgggtaacttcctgttagtggctaaagggcgaatacctttaaaagaaatttatggaattttttgattctgtcacatgttctaagaaagccttagcaacgaaatgtgggcatttatattaaaatgttgagcattttgaacttgtttactctagatatgcattattttttaaattagcattagtttaaattctttaaaaattttaatcttttaaataaatcagatgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttagagactgattcctagtaaaactattttacaagtgatcccactttaagttctgtgagtaagaagtctgatcacctcaggatggtgaaaccgagttcttctggagaatcactggaacccagtagggcagaggttgcagtgagccaag

SEQ ID NO: 402546 - DNA, 4056 bp, Homo sapiens
  misc_feature (3133)..(3133): n is a, c, g, or t
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagngtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgaatttataccctccctctctcattttcaaagggaaatctcctactccactctatctccttccctacttttactcttctttcctccactccttcttcattatccttctcatttactctatcatttctccctatctcacttcttcctcctctttctctcttctctttttcttccctttcttcccttaactccgttggcatcctcttgcacaccttttcattccgtctgctcttatcaccgctgctctatcttgccccttccg

SEQ ID NO: 402547 - DNA, 3137 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaatagaagaagctgctatgaggtctcgtaaacggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtaggcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttagagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactga

SEQ ID NO: 402548 - DNA, 2211 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaa

SEQ ID NO: 402549 - DNA, 1768 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtaaccctgataatacacaactattactggtcactcttaaaaagccatgggcaggtttccc

SEQ ID NO: 402550 - DNA, 932 bp, Homo sapiens
ggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctcgctggtgactgctgcgccgtgcctcacacagccgaggcgggctcggcgcacagtcgctgctccgcgctcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacagcaaaattctgtggcatctctggaatactacctgagaatttttgtgtgccatgtcgaagaaacgcaaatgggatgatgactatgttcgctactggttcacctgtacaacggaagtagatggaactcagcgtccacagtgtgtgttgtgtaactcagtattttcaaatgctgacctcagaccatcaaaactgtcagaccattttaacagacagcatggtggtgtagctgggcatgatctcaatagcctgaagcatatgccagcaccatctgatcagagtgaaaccttgaaagcatttggagttgcatctcatgaggatactttattacaagcatcgtatcaatt

SEQ ID NO: 402551 - DNA, 359 bp, Homo sapiens
acatagtccacgagaggagaaggacaggccaaacatttagtaatgtacatgcacagaagacaagcatgctgtgcacattaataagcaagaagttctggtggtgtcacttagaatggagaatttcagagctggaaaggtcatctacaagaaacagaggccatgcgccagctgtgggaggcaccagggagccctaccagtcaatgtctccattgccttaagtctctcccgaggggtgggaaggtggcgctcaggtcagacagcgcagacatgacaacgcgggttctggctgttaattgtaggctgtgtcttcttcacagcaaataaccccaaacagagaaataaaaatccccaaacgcacc

SEQ ID NO: 402552 - DNA, 691 bp, Homo sapiens
aaggccaagaaggaggcgccgcccatggagaagcaggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctctccctccacacctccccgcaagctgagggagccggctccgccttggccagccgagaaaggggctcccacagtgcagcggcgggctgaagggctcctcaagtgccgccaaagtggaagcccaggcagaggaggtgctgagagtgagtgaggggtgtgagggctgccagtgcgctgtcacctctcactaatttccccttagtttattttttgtttaaaatggagtttcgctcttgttgcccaggctggagtgcaatggcgaaatcttggctcactgtaacctccacctcctaggttcaagcaattctcgtgcctcagcctcccaagtagctgggattacaggcacccacacctggctaatttttgtatttttagtagagaagggatttcaccaggtaggcccggttggtctcaaactcctgacctcaggtaatccacctgccttggcctcccaaagtgctgggattacaagcgtgagccaccgcccccagcctcccttcttagaattc

SEQ ID NO: 402553 - DNA, 544 bp, Homo sapiens
cactggaaatcattgcgggactgatagagggaggtgaaaatgaaagatgaaatcatcactgtatctctgtcaaaaatgtactcgggtgtgggttttgatcagctgtagcatgtcagcaatcctgagaaaaatcaggaaagcaagaagaggatgatttgcatatctcgaaatccacatacagtcgctactcccggcacaaggccagaagtgaaagcagtcaagatctcaatatttcagacccaaaagagaaagctcccacagtccagacattgatgctataatgccatcaagaaatgggggacagcactaacacttctgccatgaagttacgtttttaagtgctcagtagtagctgttattaacacttgattttattttgtacaaaatctccttacttttttctaatcttccttaagatataattcacccttttaaagtgcatgtccagtggtttttagcatatttgcaagactgtacaacaacaacaacaattctatgaagagatcattttcatcaccccaaaaagaaaacctatatccattag

SEQ ID NO: 402554 - DNA, 389 bp, Homo sapiens
ttagtattttgtctcttctactttagccattctagtaggtgtgtaatggtattgcattgaggtttttaatttctatttctcagataattattgaaatcaagcacttttcacctgtttattggaccactgattattctcctttataaaatgtccattaaaatatttgttcatttttctattgaatcgtctttttcttaatgatttgtatgagtgtgttctagatacccaaatgctttctcagatatatgtattgcaaatacttcttccactctaacaattaccttttgattctcttaatatgccttttgatgaataaaaaattttaattttaatatatcccaatttatcaattttataaaattcttttctttttttttttgagatggagt

SEQ ID NO: 402555 - DNA, 364 bp, Homo sapiens
taggagtagtggaaagctgtgttccactcagtaccacagtgagatggtgaacttcagagtttcatggtttgttgggtgctccagaggaaacctgcacctcaacactgagtcttccagaaaaggcaaagacctccaagcttggaaccccctcctacaagggccccctcagacttggcagtgaagataatagcaacgacccagatagactgaagagtagaggtctttacccatttttccaggtcattcatgagtgtcctaaatgcttgcaagaccctaagaaggggaaaggacaccccagggaccacagaattaatttctgcttgcagtgcagcagagtgaggccaaatggacttaatttgctttg

SEQ ID NO: 402556 - DNA, 153 bp, Homo sapiens
ggctatgaggaactgaataagagatcagatttgtatttttcctttggagtcttgagaattgtaatatttgaaacccttggcagaaaataaaatcataaccaagtgactcagaaaaaacatactaatgctaactgtgtgtagtaattacaaatt

SEQ ID NO: 402557 - DNA, 369 bp, Homo sapiens
gaatgactaaaggtaaaaggactgataatatcaagtgttgatgagaatgtggctcaatcggaacccccattcattgctggctggaatacaaaatgttaaagccactttgaaaaccagtatagcgttacccattaaattaaacacatataacacggccagtcaactctcaggtatttaacaaagaaaaatgaaaatatatgcccacacaaagacttctatgtgaatattcacagaaatattatttctaatagccccaaactggaaacaatgaacagttccgtcaatggatgagtggatgaacagagtagggtacatccacaccatagaacactactcagcagtacaacagaatgaaccatggaaacacac

SEQ ID NO: 402558 - DNA, 639 bp, Homo sapiens
tgagacggagtgtcgctctgtcacccaggctggagtgcagtggtgcgatcttggctcactgcaagctccgcctcccaggttcacgtcattctcctgcctcagcctcctgagtagctgggactacaagcgcccgcccccacgcctggatgatttttttgtatttttagtagagatgggtttcaccatgttagccaggatggtctcgagctcctgacctcgtgatctgcctgcctcggcctcccaaagtgctgggattacagtaacctcttcttttattgtcacgacagactgggatttaatactggaaagttgaccctggatgctgttggcagtgaaaggcggctgtggaaatgtccaggcacaataataacagcatggagaatgagatgcagaaaggccccacattcctgctgccccagtagacaaagctgctgaatgcaggggagtccctcatgctcccttcctctctgtgtgtcctaagggccattatccaagcccatcttctgcacagctggctccaattggaacacaattcaggtgttcaaaaaatgacactataattttttggttggaaagcagaggctgaaactggtaaggaggcttcctacagcttctgaaacctcagtcatagatagttgg

SEQ ID NO: 402559 - DNA, 441 bp, Homo sapiens
agtagagatggggtttcaccatgttggccaggctggtcttgaattcctgacctcaggtaatctgcctgcctcagcctcccaaagtgctaggattataggcgtgagccaccacgccggcattttagtaattttaacggagacggggtttcaccatgttggccaggctggggtcacaaactcctgacctcaagtgatccacctgcctcagccccaagtaatatattttgcggtagctttttgatgcaaatatcagattattgtactgagacaggaatattttggactgatccttaaaaacccataaaattttaagctgcttttaaaaaaactacccaaaaatgacatccatcagacaacaacccttatcctatacccagtgggtcagggctaggctaaaccacagaaagttatggaaatgagtacatcgcttgctaaataaaa

SEQ ID NO: 402560 - DNA, 630 bp, Homo sapiens
tcaagcctctgcagacaagagccctccactaccaaagacagaggctgtgatgccaaggaaaaactcaggcctgacagtggaaagtagtaggcaatgaccccaatttggccataaaccaaccatgcagctttgggcatgcctctcacctttatgtcttccatgatgagtatgatgatattgcccatctctcagcaatacttaactactcattcttcaagacctgacttacacattgtgttctacacaaagccttccctcacatccccaagatgtagtataatcctcacctgttttccaatggtgcattggcatgctgctttgacaattacattttaattaatgctataagcctcccccagtgagtacgcactcttctacaacacgtttctattaccaatgcattgactgtttctagcatgtaacagtgctcaaggaatgtttgtttggaaggcggaaaatgggctgggcacagtggctcatgcctgtaatcccagcactttgggaggccgaggtaggtggattacctgaggtcaggagttcaagaccagcctggctaacatggtgaaaccccatctctactaaaaaaatacaaaaattagccaggcatggtggtgcatgcctgtaatccca

SEQ ID NO: 402561 - DNA, 1362 bp, Homo sapiens
gcctggacttttttttttaaataagaagagttgttagggaaagaaagttgaagaaagattatgggaaatcaattatcttcaggaagctctgggctcctgtagaacacatgtctaaaaacccctagtctagcaaaaagaagccatgcgatagagggttaaaaaaaagtgggtttttggctgggcgcagtggctcacgtctataatcccaccactttgggaggcagaggcgggcagatcacaagtcaggagttcaagaccagcctggccaagatggtgaaaccccgtctttactaaaaatacaaaaattagccgggtgtggtgacgggcgcctgtagtcccagttgctcaggaggctgaggcacagaactgcttgaacctcggtggtggaggttgcagtgagccaagatcacaccactgcactcagcctgagcgacagagactgtctttaaaaaaaataaaaaataaaaaataaatgggtgtttggacactcaatgcataatgaatgaacttgacaccaagattaaactagttaggaagagtgaatctactacttattaactgtgtgaccttggacaattaaattctctaactcatttctttttttcttttttctgagatggagtctcactctgtcgcccaggatttccttatcagtaaaacagagatactctctcccaagtttgatctataattaaatgagatgattgatgtacataaaaaatgcccagcagaaaatctagccaagactttttcttaaaagaattcaactagacttaaagtcatactcggctgacgtatctgcttattgactcatttcaaaagttcaagttatggtaccccaactcctaaaatttcagatagcctcaaggggccagagacagaaaccagagacagaggcaaaaagctacttaaccagccttaataaaatccagaaacaaggtctgtcacatgtacaaacactagctcatgtcgcacatgtaaactattactacagcattatgagatcccttccttggtaatcttactaaagcctaaacaataaccagagtgattcttcttcattagcctccaagctttcagggatttgaagtaaatctttacaaaagaatggtcactttctatgagattcaaaacaatactctaaggaatgagaacaaaattggcaggtgagaaatcttacttccccacctcttcctcctattttcattaccctgaacttagtgaattaactcattttgatcccagggctgcaatcattcattaagcactatcatttaaaccattcttcctgcctaaaactctggattcacataacctatacaacatttaacacttgagaacaagcttaaactcaatctctct

SEQ ID NO: 402562 - DNA, 1034 bp, Homo sapiens
gcctggacttttttttttaaataagaagagttgttagggaaagaaagttgaagaaagattatgggaaatcaattatcttcaggaagctctgggctcctgtagaacacatgtctaaaaacccctagtctagcaaaaagaagccatgcgatagagggttaaaaaaaagtgggtttttggctgggcgcagtggctcacgtctataatcccaccactttgggaggcagaggcgggcagatcacaagtcaggagttcaagaccagcctggccaagatggtgaaaccccgtctttactaaaaatacaaaaattagccgggtgtggtgacgggcgcctgtagtcccagttgctcaggaggctgaggcacagaactgcttgaacctcggtggtggaggttgcagtgagccaagatcacaccactgcactcagcctgagcgacagagactgtctttaaaaaaaataaaaaataaaaaataaatgggtgtttggacactcaatgcataatgaatgaacttgacaccaagattaaactagttaggaagagtgaatctactacttattaactgtgtgaccttggacaattaaattctctaactcatttctttttttcttttttctgagatggagtctcacacacgaaaaaaaagaaaacacaattgaagagcagaaactaagcctacaacaccttttggggtgtcaaaaaaagcagttaaaaactgtgggactgtgtcaaaatgacacaaaagccagcttgaaggggatctccctggccaaatctggaacaagtgtgaacacaacaaataatgacagtaacagagtattaaaataagaatccataaattccatattagtatatatacacaaaagataagaaaatgctctggcagaagaatattaactaatacgcaggaggactgacggaacaacaacaaaatttagctgaagcttgtctataatccggtagtggcaataggtggttggccgtatcccagtcttcggaactgaggggggaatacttggcccgagttggaatcgcggc

SEQ ID NO: 402563 - DNA, 496 bp, Homo sapiens
gcctctctactcactcttaatcaaagtgtggaggaggtggcccccacagcagggtttggaacctacagaccctggcccctgagacatgcagctgtcagacaagccatcatgtcaaacacaggttagagagactgagcttccagattgcatagccatttccttgactactgagtaaaggccaaggctaagatttagtaagcctagccctgaagcaagcaaagaatatggcagtgtaatgcaggtcatttagaaaaaaacaatgttgggcacaaagaaaatttagatctgacaagtataattttctaaagacattatttcaggattaacatcaatttcttagcagaggaaatgaatactattgtcagaaccatatctatatagtcaatcatttcctcttttaacgtctgtcttgttctctttttacccaccacatatgtataactatgtgaaaaattatatttgtgcataataaaatgtgataactttttacaacaaa

SEQ ID NO: 402564 - DNA, 339 bp, Homo sapiens
atggtttacagaggcctgcatgtgaagcagccccacataggctccctggccttgctgtttcacaggcagaccaagcatgcagccagcttaaggcctatgtacttcttcccctcaacctagaacttctcaaggaggcccaccctggccacctaactcagaatttcagccctccccgctctcctctgcctcttgctcgcaatacctagctctattttcacacaatctgacctactacataatttacctaattattatgtttattgcttattgactgtgtcctttcactagagtgtgaactcaaggacaagacattttgtctgctttgtttactgatgtatc

SEQ ID NO: 402565 - DNA, 408 bp, Homo sapiens
actccttccttcctttctctttcttcctttctttccttttccccttccttccttccttgcttccttccttccttctttccttcctccctccctcccttagtccgtccgtccgtccttccttccttccttccttccttccttccttccttccttccttcctctttcaacagggtcttactctgtcacccaggctggagttcagtggcacaatcttggctcaccacaacctccacctcctgggctcaagcgtggaatcacctattcttagccctatgtcaggaccatgacaatgggagaggccaccagatttccacttcctaaccaacccttgaagtcaatgttccatgtatatttttgttttgtgagtaaagaccgtaattcattacaataaaactatgtttttaaaaa

SEQ ID NO: 402566 - DNA, 215 bp, Homo sapiens
gaggaccccaggaatgatcagatgtggggactggaaacaaccagggagagcactgaacacagtgttttccaccatgtgctttgcagcctcttagagagctggaaaatccatttaagtgggtcacagccagcattccaaaaactgaaacagaacagaaatgatctgagcacactgtaagtattgttttgtaaaacctctgccttaattgcattata

SEQ ID NO: 402567 - DNA, 575 bp, Homo sapiens
aagacccagaaacacgctctcaccttacccttaagaattctttcccaacattaagtgtaagctctccctggacttaggccaagtaagtactaacctgggtttattagcagtctgaatttttaggcaatattgaatgtgtccatttgttttctcggggaagggttcccagtgttcattagactctcaaagaggcagtggctccaaaaatattaagaattactgtccaggccaaagagctgagacttggagacacctccttaatccagtcttgtttgaatcctagctggacacacacagaggagactagcactcaggggacagtgatgactacattgctgtggcttcttactggtgtttgctggaaggtttgattttatcaacaccccttcttagcctgagggtttctacgtgctggcaatgcctgaatgccctgtggttgaaaaagtgcctctgacatgaggcctgggttctgtattaaggggaaaaaggctcaagaaataaggacacaggccctaatggaagagattggggaacggacgtcatggtatccatggaggttggctttattttctctg

SEQ ID NO: 402568 - DNA, 172 bp, Homo sapiens
ttttgtatgccgcttccagcccccggcctgggtttggggagaaaactcagaagtaggcagatgatcccagccaggtttggtttatcttgcaagaataacgaattgttccccaccccaaccacccaagttttcttgttcgagaagattgagtagactaaggtggctcagtgac

SEQ ID NO: 402569 - DNA, 145 bp, Homo sapiens
tgggaggctgtgatgggaggatcactggagcgtgggaggtcaaggctgcagtaagtcatggttgtgccactgcacttcagcctgggtgacagagtaagaccctgtctaaaaagcaaaataagatgcagtttggagtgtaaaatag

SEQ ID NO: 402570 - DNA, 155 bp, Homo sapiens
tgaatgtataagcattattagaaataatctgcatatgttctaggaaagttgtcaactatatatattttgacaattatatatacatatatctgtgtgtataagaaggctacaaaatagtaattctaggttatgactgaattctttttttttttttt

SEQ ID NO: 402571 - DNA, 523 bp, Homo sapiens
agtgcaagtagcataagcaatcttctataataatccttcctcgtgcataggaaatgcgtactatgcaatccagtaatgtattgtaatgtgagagagggtggtagcactaatggttgaatacagagaggttaaagtaatccacaccagctcaaaggacctgtggagatccagttggcacattgctgcctgggggtttcaaatctctgttggctggagaatactggtgggggtagctggaggacccagttgggaggtcctgtccagtgaggaggaacagcatcaggggcctgcttacagaagcaatctggccatgatttggtaaagcagctgtgctgtgctgcgggatctcttctgcccctggtcagtttgtactctccaaagccagcaggctggaatggctaagttgcccaaacaggaaagatggtagcctgccccatcttttctctcagagtttatcttgtgtgatggggcttaatttttagggtgttaattttactgtcagcattagagagttgttcagaaa

SEQ ID NO: 402572 - DNA, 392 bp, Homo sapiens
tttttttttttttttgagaactaagttgaaggaaaaacaatgtctggcaggagcaagagccctgatgacctcttgtttcccacagttctgctgttgcctgtttgggggagaggaatgtggcactcctctctccaggatggtggccttaaagtgtatgaaaagtcattcctagtctccactttggtttcttctgtttgatttggaatttgggttacatcatctttgccaaccccttcttcttccacaccctttgtaaaatgggtcagaagcaggacttcttttcttcttaaactgagcaagtaggggaagtggcatacaaatcgaactattctgttttgtttacctattctctttaaaactgcccttctgtcgtcttcttgttttcttttgaa

SEQ ID NO: 402573 - DNA, 385 bp, Homo sapiens
tttgcatagaatctgatgtaattgcttaataaatgttagctgtcattattatataaagttctagcaatgtcatgaaggggacgtggctatttaaaatgtactcttctctggaaagggaaagtggaaaattattaatgtaatgattgttattagcaaaacaaacattgttacacttcaggccctcccagccctcatgttgttatcattcaggttcttttttcttcatgtgttacatgaacacaacctgatttatatttagggtaacaggaaggaaactgtgcctatatcgtaggatggaaaaagggattccctgggctccctgtcccacgtgtgtggttactcatccaataaatttatattcttagtattttaaaaatcccttaaa

SEQ ID NO: 402574 - DNA, 251 bp, Homo sapiens
tgcattctcctatttttgtccagaaaacattgatttgtgctgagtgcctcttccagctttccctttacagccctgatcccaggagaagccaggtactggtcttttaaaagtcttgaggcctgagaatttgaaaatgaaactcagaagaacaatgggaataatcagagggcagggccccgtggcttgttcagctctgccccggaagagcctggcatgcaggaggtgttggggaatcaagtccccaggaatag

SEQ ID NO: 402575 - DNA, 1041 bp, Homo sapiens
tattttttcagttgacatgacctttaaggttcctccaaactaaggttctaatttttttttttaacttgcagtcttactcccaacaagaaatttgatatattagagctaacagttctaagaagttttaagaaatagtatgcaatcccaatactggacatcacactgtaaattaaattcattaaaatgtaaaatgtgtttagttcaaatatttaaagacaggagactgctgctatgtaataataacagagaggctatttctgcagcttctgttgtctcctttaggaaaggaaggagttgggcaaaatgaattttaagaacgcttagaactctacaaatatgtaattctttatctacaaagaacatatttctggaaattcttaaaagagaaaaataatcaaaataatggccttcattcccacctgtttggtcatggacaagtccaatattttggaaatgtagacaaggacacctagtaaagggtcttttgaaagaataaacttagtttagtcttctcctttaatgtaaagaaactaaggccccaactgacaaactgagaccaaagtcaaaatcatgcggttagtattctaatgttctattcactttatcacactgtataacaaaagtctgtcagttaccatatacttctattcatacattatgtgttttatatagcaacattttccagaatccaggcagcgagtgattaaactgaaaggcattatctaatgcccagcctgattttgtgattttaacaggtcagattacgcatctcactctttgatttgaacactgattgcttaaagatacttaaaaagtttcatatcccagagctgagccatttaatacctcaaagtaaaggtattcctttctcataaagatttaacctcagagccagctttgcacttctgcaatcacctcttctgaagagccagtttcaacgaatccattatttaagatacctgacttactagcctcttctcggtcttatctgtaaattagaagtttttagaatgaatatctaatttgtgcactgtgtacctg

SEQ ID NO: 402576 - DNA, 5751 bp, Homo sapiens
  misc_feature (4924)..(4924): n is a, c, g, or t
  misc_feature (5480)..(5481): n is a, c, g, or t
  misc_feature (5484)..(5484): n is a, c, g, or t
  misc_feature (5494)..(5494): n is a, c, g, or t
  misc_feature (5502)..(5503): n is a, c, g, or t
  misc_feature (5524)..(5524): n is a, c, g, or t
  misc_feature (5573)..(5573): n is a, c, g, or t
  misc_feature (5577)..(5577): n is a, c, g, or t
  misc_feature (5580)..(5581): n is a, c, g, or t
  misc_feature (5595)..(5595): n is a, c, g, or t
  misc_feature (5635)..(5636): n is a, c, g, or t
  misc_feature (5641)..(5641): n is a, c, g, or t
  misc_feature (5649)..(5649): n is a, c, g, or t
  misc_feature (5668)..(5668): n is a, c, g, or t
  misc_feature (5671)..(5671): n is a, c, g, or t
  misc_feature (5676)..(5677): n is a, c, g, or t
  misc_feature (5697)..(5697): n is a, c, g, or t
  misc_feature (5701)..(5701): n is a, c, g, or t
  misc_feature (5740)..(5742): n is a, c, g, or t
  misc_feature (5747)..(5747): n is a, c, g, or t
gagaggttgtaatggaaaaacctagagcaaacgaaaccaatattccttccgagcaatcactaccaggaaaagaggctaccttactagattttggctggagaagtgcatttaaagaagtgtctcttcccatggcgcactgcgtagtaactgcaattgaaggtttttccacaaaaattctccaacaggaacagaatgaaaggtcttcagctgtgagctatgctatgaaccttgtaaatgtccagcaagtttggcaagacagccatatgtttcctgaggaggaacaaccaaagaaaattggaaaattttgttctgacatcatggaaaaacttgacacaatgcttccactggctctggcatgcagagatgattcttttcaggaaattagagcaaacttggtggaggcctgttgtaaagtggcaacagctgtcctgcagagactgcaagagagagccaaggaggttccttccaaagcacccctgaaaaacttgcacacatacctctccacagcggtgtatgtcttccagcatttcaagcgatatgataatttgatgaaggaaatgactaaaaaacccatattcctggtgcttgtccaacgatatcaggaattcatcaacactctacagtttcaggttacgaactactgcgtcagagtttgtgctacaagcattttacaggatgctgagagccaccactgggatgactacaaagctttttatgagggggaaagatgttccttctcgatccagatgtggcattatttctgctggtctcttcattacgatctctggaccattctgcctcctaagttagcccaggagattctagtggaagtgctggagaaatctttgagtctactggcctccagatacgctcgggcccaccccagccgtaaaagaactccacagttaagacttgatgtcacaacaattttgatatgcactgagaacatgttatggtcagtttgtacatctgtacagaaacttttgaatcctcatcagcatacagatgataaaatttttaaaattcacactcattgtaataatctgtttacaacattagtcattttgacttcaccattaacagaattatataagacttttcagcatggcctggatgagtctgcttcagattccttaaaatcattttttaagcaaccattatattgggtttcttgcatatcacatttctacccttctttactcaggactccatcagctggaggactgaaagccgagggtcagttgaaactgctcttatcccagccacgttgtaactggaacttgcttctggaaaccctactgcatcatgatggacttttactgagaatcttgctgaagagctcaaaacgtacctttcaagaacaagtttccgacacagaaaataacctgaaccaaggacccagcttgatggaaaccatctttagaatattgtaccattgcagtttttctccacaaacatttgcaaacgtttttgtgagctacatggaagaagagcaattatgggactttttatataacatcccaggtatgagacatttactgtttgtaaaagaaatgttctatagatacttatatgtacctttaaagatgtttagaagttgtattgatactggttttgctgaatctgttgttggtgaaagtttaccttacattttttcagtataaagccttctgttgggaatcattaattattggttcctgtaaaatttcatatactttgggacaagatgcaagggaggtggaagggaaaagattttctttttttattaattagggaatgttctatcataaaaatttattttaatatttatcacagattatgttttgctattgagcatataagatattagtaagatgtgaaaagtattttgtgattcttgggtgcatttattcagcaaattaatggacaatactattggtcgattttcttcagatgtataaggcatttattattatgaccatagtgtgtctctctacaaggcaagcatatcctgtgattcctttggagagaatatatttttcccatctgtattgttcttcttccttcagctagagagaataataaaggcagtgcaggttgtatatttgaacaggaagttttgatgggttgccccaccctctggcaggcgtaaaaattctcacattgtcttatccttaatattctgcctttaaattttcatatttaatatcttgtgaaaacaaaggatgaaaacttagacaatgatttttattattatcctgctattcaaatagtgatttttatcatttacatttagttttcaacctgtaagctttcttttatcctgctttggaacctgaattttcataaaatatttcctaggctccatataaaagatctaactagttcataatcatggtttcactcctcccagactttttgactatcctccagatattacttgaatatcattctagctgttttacagtcattatgtttcattttctcttggccattatccctataaactagcaatagataactttatgttatgatttccaaagtccaaatctgtcatttaaagtttctgtaataatgatctctttttaaaatgttatctcctagttgccatgcattcccttactgcttcttgcttcccaaaggaagggcatattcctaggtaaaaaggctgaattagaagcttgttgtgtttctgatgtagtctttattgaattgaaagaaaaacgaacttgaaagttctgccaccctctgctgattttagttgtttctggggaagtaagagctggattttctcacaagattataaagaatcagtgaccctcatgcttcaatcactatttatctttcaactattaggttcttgaaccatctttgacactcagcacaaaactatacttaaaataacctagaagatataaatggatttcaggtgctgctagggaaaataaaactgtttcttgctcctaatttgacatctctccatgtatgtagtgagcaaaccctcccctacatggtcagacaagtctctggaaacagacgttatacatattcacagagcctgaattatatgtgaaagctcaaaggggcagaacttcaaatgggtgaaactcccttctcctttatacaagttgttgctccataaacattaaatattctctggaacctgatacctgcagtggttatgagggtctgaagttttctcttttctctcccatttaagtctttgaaaatatctttttttttttctgttagcaatcatggttattttaaaaaccctaataagataatacaaggtactaattcataacgaaattaagccttttactatgacttttgtttaatttggaaacataacattgttacaagtaatacagctgagacatgtaatcataatcccgcaatatttacattttattactaatagatctatgcttcagtatctataattaacctacccagattaactaaagtacattattttaaaacttcactgctgtagtttcctcctgctaaatcactgtctatgatttctgcacagtttacccataaaacatcacagtcttatcattttagggtaaaaggacaaagatgaagtggtatcttcatcttattgttgagtaaacaaaaagcagaaatattaagagagttgcctaagactgtccaccaattaagttggacaagacttagcacaagaaaccagatctcctctctcctaaggcagcagtccccaacatttttggcaccagggaccagttttgtggaagacagtttttccaccaggagggggatggatgaaaccgttccacctcagatcatcaggtattggttagattctcataaggagcaaacaaccaagatcccttgcatgtgcagttcacaataggatttgtgctcctatgagaatctaacatgcttctgatttgacaggaggggaagctcaagcagtaatgctcacccacctgctgctcacctcctgctgtgcggcccagttcctaacaggtcacgaacctgtactggtctgcagtctaggggttggggaccctgtcctaggccatgttatttctcatttttttctattagactaaattttttgagacactacttttatgaacatacgaattcagtaatgaattatacaatctgattttatacttagaattctatctaacacataactctttagactggacataagctagggagggatgacaagaaggaaaatacccacttaagattactacaaaagctataagtacaacaaataattaagtcagtgacctaatgtgggtgtttctaaggccaatgcactctgtaagaaataaatttgctaacaatcattggacacctatgttttcaaagtagatcaagcattattcagttagacaaatgaaaatatcaaagcatacattacctcagctggtttttaagacaatgtcagaacaggcttgtaaatgaggcaaatactgtcaaaaatgcccatctaatatgatagtaatatactcaaaaagtattgtttacttggctcctcgataatggcattgggcttacttttgttttctgaatcagttttcttaactttctcccaacctttgggaaaaaagttttccataacctagcaaaattaagggttgagattcaaagtttccactttggttttctactcctcctcagcctcataaagacctttaagaagtgttgtctagagagcatatatatgctatattgtctgcctgttgccaaaattaatttacagtgccttaccttcctatcagacacagtgattgtctctattacctacataaatacctgcgccatagtataggtagattttaaatgtaagctttcacatattgaaaggctgtctttgttctatgttgtaactaatcatgtattctgagccttttgtcaccagtttgtttgcaatccaccttaaaaatgttttaanatatatttattgattgaatacaataaaattcactcatttcaagtgaagagttcagtaagtttgaccaatgtataaatctgtgtgacaaccacaacgataaagatatggaacattttatgtcatctccaaaggttctttcattccccctttgccgtccattctcctttcaactctcagccccaggaagacactgacctgctttttgtcgtgatagtttacttttgatattctagaatttcatataaatagaaatctatatattcttttgtgtctagcttcttttgctcagcttaatgtttttgataattttatattatgctttatcattagtttatttctgctcattgctgagcagtatttcactgagtagtactttttttatccacttaccagttgggtggacattttgattatttctagtttttggctacgatgaataaagctgctatgaatactagtgtataagtctttgtgggactacagtcatccctcagtatatgtgaggaattcattccaggaaccattccccttcttaaaaaatccatatactcggccnngcntggtggctcncgcctgtnntcccagcactttgggaggccnaagtgggagatcatctgcggtcgagagtttgagaccagcttgaccaacntggnganncctcgtttctactnaaaatacaaaattagctgggcatggtggcatgtgcctgcnntcccngctactcnggaggctgaggcaggagantcncttgnncccgggaggtggaggttgcngtgngccaagacgccattgcaccccagcctgggcaatgagtgnnncttcntctc

SEQ ID NO: 402577 - DNA, 1926 bp, Homo sapiens
gagaggttgtaatggaaaaacctagagcaaacgaaaccaatattccttccgagcaatcactaccaggaaaagaggctaccttactagattttggctggagaagtgcatttaaagaagtgtctcttcccatggcgcactgcgtagtaactgcaattgaaggtttttccacaaaaattctccaacaggaacagaatgaaaggtcttcagctgtgagctatgctatgaaccttgtaaatgtccagcaagtttggcaagacagccatatgtttcctgaggaggaacaaccaaagaaaattggaaaattttgttctgacatcatggaaaaacttgacacaatgcttccactggctctggcatgcagagatgattcttttcaggaaattagagcaaacttggtggaggcctgttgtaaagtggcaacagctgtcctgcagagactgcaagagagagccaaggaggttccttccaaagcacccctgaaaaacttgcacacatacctctccacagcggtgtatgtcttccagcatttcaagcgatatgataatttgatgaaggaaatgactaaaaaacccatattcctggtgcttgtccaacgatatcaggaattcatcaacactctacagtttcaggttacgaactactgcgtcagagtttgtgctacaagcattttacaggatgctgagagccaccactgggatgactacaaagctttttatgagggggaaagatgttccttctcgatccagatgtggcattatttctgctggtctcttcattacgatctctggaccattctgcctcctaagttagcccaggagattctagtggaagtgctggagaaatctttgagtctactggcctccagatacgctcgggcccaccccagccgtaaaagaactccacagttaagacttgatgtcacaacaattttgatatgcactgagaacatgttatggtcagtttgtacatctgtacagaaacttttgaatcctcatcagcatacagatgataaaatttttaaaattcacactcattgtaataatctgtttacaacattagtcattttgacttcaccattaacagaattatataagacttttcagcatggcctggatgagtctgcttcagattccttaaaatcattttttaagcaaccattatattgggtttcttgcatatcacatttctacccttctttactcaggactccatcagctggaggactgaaagccgagggtcagttgaaactgctcttatcccagccacgttgtaactggaacttgcttctggaaaccctactgcatcatgatggacttttactgagaatcttgctgaagagctcaaaacgtacctttcaagaacaagtttccgacacagaaaataacctgaaccaaggacccagcttgatggaaaccatctttagaatattgtaccattgcagtttttctccacaaacatttgcaaacgtttttgtgagctacatggaagaagagcaattatgggactttttatataacatcccagtctcaacgtgcgtggagtacgagctagaggtcatccgatgcttgagactggcactgaccgatgccatcaaggacgctgtacagcagatagtatctgtaatgagttctaggagaaactgtgagacaaacctaaacaagcacgttgttcctgattgtttgcttgagagcatgccaaaggaatggaattatggtccaaaagaaactaacaggaaagaatcatgcaaaagcttcacaaggcttactgctcaggcagtatctattgtaatcagcaagttacctacggtgattgcatgtttgcctcccccagttaaatacttcttttttctgtctgagagaaaaatgtcaaaaaaatttgttgaattgaagaaagctggcctgcttgtctggaacttgattgtaatta

SEQ ID NO: 402578 - DNA, 555 bp, Homo sapiens
tgagcagactgcgccattgcactccagcctgggtgacggagcgagactccatctcagacaaaaaacaaaaaaaagaacttctggctcatagcaacaccagatgtttttcaagaggagctgtgacactcccctgcacggaatgctgtgaaatttcgtgggggctggtcacgtaattgggttgggggtgtggttgaaatgtgggcaggagccatgcatgctgccaagatggtgaggaacagaactgcccccagtggaccacatcaacagatgtggaataagcagttttcagggtatgaactgagaacctaactggacttcacacataagcacaaactaattgctgcatgcttggaatttacccagaatttcccagaaatgcaatagcatattatgttgttaaaaacttttccaagagttagtcactactttggaaggtcacgttccacatgggaaggcccctcacagtattgccatggtcaacatcataccctctaccagtccacaagcaacaggctattgccctaggtctcctggcaaaattgggcccacagtgac

SEQ ID NO: 402579 - DNA, 3851 bp, Homo sapiens
  misc_feature (3845)..(3845): n is a, c, g, or t
cccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacagagtctcacactgtggcccaggctggactccagcacagtggcatgatctcagctccgcctcctgggttcacgtgattctcatgcctcagcctcccgggtggctgggatcacaggcgtgcaccatcacgcccggctaatttttgtattttcattcgagaccagcctggccaacgtggtgaaacaccgtctctactaaaaatacaaaaaattaggtgtggtggtgcgtgcctgtattcccagccactcgggaggctgaggcaggagaatcgctggaacctgggatgtggaggttgcagtgagccaagattgcaccactgtactccagcctgggcaacagagggagactccatctagactccatctcaaaaaaaaaaaaaaaaaaaaaaaaaaaaaaaaaaaaaaggattattctaagcactagaactacataagaatgtcctaaagcactgtatctaagcacttgaaaagaatgggacttttcggttttagggagataactattagcaaccacacaatatgttatctttatggatgaataacttctggtaatgacacagtgtcttacagctacatcatttataaaatcatgtgtcagttttcacacagcctgcacatcgttctgacatgccctttttttccctggagatttatcctcatgacatacaaggggacaaaaatatttattgggactgtctttgaatttagtagaatcactgtatcattaacagtttggggaagtactgctttgcagtcctttatttgaaaacttaggtctagctgtgttttgcatcaaaatttttgagctattcaaaaactaataggatctgtgtaaaatatttcactcaaaactactaaaaaaaagtctggtccttcggcgtgtgcagaggntcctct

SEQ ID NO: 402580 - DNA, 4148 bp, Homo sapiens
  misc_feature (2631)..(2632): n is a, c, g, or t
  misc_feature (2649)..(2649): n is a, c, g, or t
tttcctttggatcctaaaagaagaaaagaatgggttcgcctggttaggcgcaaaaattttgtgccaggaaaacacacttttctttgttcaaagcactttgaagcctcctgttttgacctaacaggacaaactcgacgacttaaaatggatgctgttccaaccatttttgatttttgtacccatataaagtctatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacagagtctcacactgtggcccaggctggactccagcacagtggcatgatctcagctccgcctcctgggttcacgtgattctcatgcctcagcctcccgggtggctgggatcacaggcgtgcaccatcacgcccggctaatttttgtattttcagtagagacagggtttcgccacgttggctaggctggtctcgaactcctgacctcnngtgatctgcccatctcngcctcccaaagatctattacaagatgtgagccactgtgcccagccaccagggcatgtttttaaaaaagtactgatgtctgggtttcacactgcaaaattctgatttatctgatctaaggtacagcctggatattgagactttttaaagctctgactgtacattgaatcatcatgtaaggagtttttaaaacattgttgccagggcccctttctagaccaagttagtcagaatgttggacaatgaggcccatgcatgggtatttttacaaagctctctgggagattctaatgcttaaccaaattgagaagcactgaataagaatatcctgggccgggcgcactggctcatgcctgtaatcccagcattttggaaggccgaggcgggtggatcacttgaggtcaggagttcgagaccagcctggccaacgtggtgaaacaccgtctctactaaaaatacaaaaaattaggtgtggtggtgcgtgcctgtattcccagccactcgggaggctgaggcaggagaatcgctggaacctgggatgtggaggttgcagtgagccaagattgcaccactgtactccagcctgggcaacagagggagactccatctagactccatctcaaaaaaaaaaaaaaaaaaaaaaaaaaaaaaaaaaaaaaggattattctaagcactagaactacataagaatgtcctaaagcactgtatctaagcacttgaaaagaatgggacttttcggttttagggagataactattagcaaccacacaatatgttatctttatggatgaataacttctggtaatgacacagtgtcttacagctacatcatttataaaatcatgtgtcagttttcacacagcctgcacatcgttctgacatgccctttttttccctggagatttatcctcatgacatacaaggggacaaaaatatttattgggactgtctttgaatttagtagaatcactgtatcattaacagtttggggaagtactgctttgcagtcctttatttgaaaacttaggtctagctgtgttttgcatcaaaatttttgagctattcaaaaactaataggatctgtgtaaaatatttcactcaaaactactaaaaaaaagtctgggatggcagctcattatcaaatatactcctatttttgtggtgatttatgaacatccccactaagtataactaaagatcataaagagcctcagatcaagtttggtcaggttttgtcaccaagctttgtaaataaactggttttcatagctttttggagatgagaattgaggataagaaattgtgtctctgtcctttttttttttttttgttaagtcttacatgtattttactgtaacatcttttgaattggatatttaactaattcaacatatttttcctctttgcagaatgggcagttcatgttaaaatcacttttcatggaaagagctctatgtaacagcataataaaactgcctacctagcagcaaaaaaaaaaaa

SEQ ID NO: 402581 - DNA, 4340 bp, Homo sapiens
  misc_feature (2823)..(2824): n is a, c, g, or t
  misc_feature (2841)..(2841): n is a, c, g, or t
cccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacagagtctcacactgtggcccaggctggactccagcacagtggcatgatctcagctccgcctcctgggttcacgtgattctcatgcctcagcctcccgggtggctgggatcacaggcgtgcaccatcacgcccggctaatttttgtattttcagtagagacagggtttcgccacgttggctaggctggtctcgaactcctgacctcnngtgatctgcccatctcngcctcccaaagatctattacaagatgtgagccactgtgcccagccaccagggcatgtttttaaaaaagtactgatgtctgggtttcacactgcaaaattctgatttatctgatctaaggtacagcctggatattgagactttttaaagctctgactgtacattgaatcatcatgtaaggagtttttaaaacattgttgccagggcccctttctagaccaagttagtcagaatgttggacaatgaggcccatgcatgggtatttttacaaagctctctgggagattctaatgcttaaccaaattgagaagcactgaataagaatatcctgggccgggcgcactggctcatgcctgtaatcccagcattttggaaggccgaggcgggtggatcacttgaggtcaggagttcgagaccagcctggccaacgtggtgaaacaccgtctctactaaaaatacaaaaaattaggtgtggtggtgcgtgcctgtattcccagccactcgggaggctgaggcaggagaatcgctggaacctgggatgtggaggttgcagtgagccaagattgcaccactgtactccagcctgggcaacagagggagactccatctagactccatctcaaaaaaaaaaaaaaaaaaaaaaaaaaaaaaaaaaaaaaggattattctaagcactagaactacataagaatgtcctaaagcactgtatctaagcacttgaaaagaatgggacttttcggttttagggagataactattagcaaccacacaatatgttatctttatggatgaataacttctggtaatgacacagtgtcttacagctacatcatttataaaatcatgtgtcagttttcacacagcctgcacatcgttctgacatgccctttttttccctggagatttatcctcatgacatacaaggggacaaaaatatttattgggactgtctttgaatttagtagaatcactgtatcattaacagtttggggaagtactgctttgcagtcctttatttgaaaacttaggtctagctgtgttttgcatcaaaatttttgagctattcaaaaactaataggatctgtgtaaaatatttcactcaaaactactaaaaaaaagtctgggatggcagctcattatcaaatatactcctatttttgtggtgatttatgaacatccccactaagtataactaaagatcataaagagcctcagatcaagtttggtcaggttttgtcaccaagctttgtaaataaactggttttcatagctttttggagatgagaattgaggataagaaattgtgtctctgtcctttttttttttttttgttaagtcttacatgtattttactgtaacatcttttgaattggatatttaactaattcaacatatttttcctctttgcagaatgggcagttcatgttaaaatcacttttcatggaaagagctctatgtaacagcataataaaactgcctacctagcagcaaaaaaaaaaaa

SEQ ID NO: 402582 - DNA, 3971 bp, Homo sapiens
cccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccgtctctactaaaaatacaaaaaattaggtgtggtggtgcgtgcctgtattcccagccactcgggaggctgaggcaggagaatcgctggaacctgggatgtggaggttgcagtgagccaagattgcaccactgtactccagcctgggcaacagagggagactccatctagactccatctcaaaaaaaaaaaaaaaaaaaaaaaaaaaaaaaaaaaaaaggattattctaagcactagaactacataagaatgtcctaaagcactgtatctaagcacttgaaaagaatgggacttttcggttttagggagataactattagcaaccacacaatatgttatctttatggatgaataacttctggtaatgacacagtgtcttacagctacatcatttataaaatcatgtgtcagttttcacacagcctgcacatcgttctgacatgccctttttttccctggagatttatcctcatgacatacaaggggacaaaaatatttattgggactgtctttgaatttagtagaatcactgtatcattaacagtttggggaagtactgctttgcagtcctttatttgaaaacttaggtctagctgtgttttgcatcaaaatttttgagctattcaaaaactaataggatctgtgtaaaatatttcactcaaaactactaaaaaaaagtctgggatggcagctcattatcaaatatactcctatttttgtggtgatttatgaacatccccactaagtataactaaagatcataaagagcctcagatcaagtttggtcaggttttgtcaccaagctttgtaaataaactggttttcatagctttttggagatgagaattgaggataagaaattgtgtctctgtcctttttttttttttttgttaagtcttacatgtattttactgtaacatcttttgaattggatatttaactaattcaacatatttttcctctttgcagaatgggcagttcatgttaaaatcacttttcatggaaagagctctatgtaacagcataataaaactgcctacctagcagcaaaaaaaaaaaa

SEQ ID NO: 402583 - DNA, 1581 bp, Homo sapiens
cccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataagaatgggcagttcatgttaaaatcacttttcatggaaagagctctatgtaacagcataataaaactgcctacctagcagcaaaaaaaaaaaa

SEQ ID NO: 402584 - DNA, 4201 bp, Homo sapiens
cccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacagagtctcacactgtggcccaggctggactccagcacagtggcatgatctcagctccgcctcctgggttcacgtgattctcatgcctcagcctcccgggtggctgggatcacaggcgtgcaccatcacgcccggctaatttttgtattttcattcgagaccagcctggccaacgtggtgaaacaccgtctctactaaaaatacaaaaaattaggtgtggtggtgcgtgcctgtattcccagccactcgggaggctgaggcaggagaatcgctggaacctgggatgtggaggttgcagtgagccaagattgcaccactgtactccagcctgggcaacagagggagactccatctagactccatctcaaaaaaaaaaaaaaaaaaaaaaaaaaaaaaaaaaaaaaggattattctaagcactagaactacataagaatgtcctaaagcactgtatctaagcacttgaaaagaatgggacttttcggttttagggagataactattagcaaccacacaatatgttatctttatggatgaataacttctggtaatgacacagtgtcttacagctacatcatttataaaatcatgtgtcagttttcacacagcctgcacatcgttctgacatgccctttttttccctggagatttatcctcatgacatacaaggggacaaaaatatttattgggactgtctttgaatttagtagaatcactgtatcattaacagtttggggaagtactgctttgcagtcctttatttgaaaacttaggtctagctgtgttttgcatcaaaatttttgagctattcaaaaactaataggatctgtgtaaaatatttcactcaaaactactaaaaaaaagtctgggatggcagctcattatcaaatatactcctatttttgtggtgatttatgaacatccccactaagtataactaaagatcataaagagcctcagatcaagtttggtcaggttttgtcaccaagctttgtaaataaactggttttcatagctttttggagatgagaattgaggataagaaattgtgtctctgtcctttttttttttttttgttaagtcttacatgtattttactgtaacatcttttgaattggatatttaactaattcaacatatttttcctctttgcagaatgggcagttcatgttaaaatcacttttcatggaaagagctctatgtaacagcataataaaactgcctacctagcagcaaaaaaaaaaaa

SEQ ID NO: 402585 - DNA, 4679 bp, Homo sapiens
  misc_feature (3162)..(3163): n is a, c, g, or t
  misc_feature (3180)..(3180): n is a, c, g, or t
cccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacagagtctcacactgtggcccaggctggactccagcacagtggcatgatctcagctccgcctcctgggttcacgtgattctcatgcctcagcctcccgggtggctgggatcacaggcgtgcaccatcacgcccggctaatttttgtattttcagtagagacagggtttcgccacgttggctaggctggtctcgaactcctgacctcnngtgatctgcccatctcngcctcccaaagatctattacaagatgtgagccactgtgcccagccaccagggcatgtttttaaaaaagtactgatgtctgggtttcacactgcaaaattctgatttatctgatctaaggtacagcctggatattgagactttttaaagctctgactgtacattgaatcatcatgtaaggagtttttaaaacattgttgccagggcccctttctagaccaagttagtcagaatgttggacaatgaggcccatgcatgggtatttttacaaagctctctgggagattctaatgcttaaccaaattgagaagcactgaataagaatatcctgggccgggcgcactggctcatgcctgtaatcccagcattttggaaggccgaggcgggtggatcacttgaggtcaggagttcgagaccagcctggccaacgtggtgaaacaccgtctctactaaaaatacaaaaaattaggtgtggtggtgcgtgcctgtattcccagccactcgggaggctgaggcaggagaatcgctggaacctgggatgtggaggttgcagtgagccaagattgcaccactgtactccagcctgggcaacagagggagactccatctagactccatctcaaaaaaaaaaaaaaaaaaaaaaaaaaaaaaaaaaaaaaggattattctaagcactagaactacataagaatgtcctaaagcactgtatctaagcacttgaaaagaatgggacttttcggttttagggagataactattagcaaccacacaatatgttatctttatggatgaataacttctggtaatgacacagtgtcttacagctacatcatttataaaatcatgtgtcagttttcacacagcctgcacatcgttctgacatgccctttttttccctggagatttatcctcatgacatacaaggggacaaaaatatttattgggactgtctttgaatttagtagaatcactgtatcattaacagtttggggaagtactgctttgcagtcctttatttgaaaacttaggtctagctgtgttttgcatcaaaatttttgagctattcaaaaactaataggatctgtgtaaaatatttcactcaaaactactaaaaaaaagtctgggatggcagctcattatcaaatatactcctatttttgtggtgatttatgaacatccccactaagtataactaaagatcataaagagcctcagatcaagtttggtcaggttttgtcaccaagctttgtaaataaactggttttcatagctttttggagatgagaattgaggataagaaattgtgtctctgtcctttttttttttttttgttaagtcttacatgtattttactgtaacatcttttgaattggatatttaactaattcaacatatttttcctctttgcagaatgggcagttcatgttaaaatcacttttcatggaaagagctctatgtaacagcataataaaactgcctacctagcagcaaaaaaaaaaaa

SEQ ID NO: 402586 - DNA, 2183 bp, Homo sapiens
cccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactggtaagaacattccttcattcttgcaacttattggtatgttaaagaaatagggaaaagaaagaaaaaaatgttaacaatgaaaacaaatccaaagacacagggtgttgagggactagaaatgatagggcaaagtctctttcacaattttggttttcttattcttttgtattaaattaattgaaagagaattagtcccgcgcagcaatgattagaagccatgtggggaagatacaatagtgcagagaacagacgtttttgtgtgagccattacctaatcccagaaaagcaagacgtttgggatcagatcattttaatacaattccttccattcattttcctattccatttgaggagtaattgtacaaatctgactatacacacgacctactttcttactgtggtatcatgcttgctattcttgcccctgagttttttgcttcattaagatatatggtcgatgtctgggcacggtggctcacatctataatcccagcactttgggaggccaaggggggcagatcactggaggtcaggagttcgagactagcctggccaacatggtgaaaccccatctctactaaaaatacaaaaattatctggtgtagtggcgcctgcctataatcccagctacttgggaggctgaggcaggagaattgcatgaacctgggaggcggagattgcagtgagccgagatcatgccactgcactatagcctgggcaacagagcaagactccatctc

SEQ ID NO: 402587 - DNA, 2657 bp, Homo sapiens
cccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtt

SEQ ID NO: 402588 - DNA, 1728 bp, Homo sapiens
cccacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactgaatgggcagttcatgttaaaatcacttttcatggaaagagctctatgtaacagcataataaaactgcctacctagcagcaaaaaaaaaaaa

SEQ ID NO: 402589 - DNA, 399 bp, Homo sapiens
gcaaggccaagattccctgagtgacgtctcatagctcattggatttttcttcaaggcctttatccacccatataagtgtgggatatgggtgaaagaacaagtttgcagaaaagatacagtgaattatggaccatgagttcgggaaagaagggtaggactgcgtcgctggctgcagtattctggaggctggtctttgggctgtgatcactcttcattctaaaggagacattttcagaacatcagggatatatcctgccctgggatgctgatgaatggccgctttaagactcactgagacactttggtgcacggctcagagtgctctgaaggagtagttttaattcagcagttttgatgtggaagcaaaaatatataaaatggcattatattgctgggtaa

SEQ ID NO: 402590 - DNA, 869 bp, Homo sapiens
gcacgagctcgtgccgattcggcacgatcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattctt

SEQ ID NO: 402591 - DNA, 249 bp, Homo sapiens
gcctactcattcaaccaatagccctggcagtgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattctt

SEQ ID NO: 402592 - DNA, 356 bp, Homo sapiens
tcaattctttgaatgagctggtggattatcacagatctacatctgtctccagaaaccagcagatattcctgcgggacatagaacaggtgccacagattgggccatggctttcatcctgtgtcccctgacctgtccagtgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattctt

SEQ ID NO: 402593 - DNA, 1481 bp, Homo sapiens
caggagaatcgcttgaacctgggaagtggaggttgagtgagccgggaccgtgccattgtactccagcctgggtgacagagcgagattccgtctcaaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaagacagtccagagcttttcagccaatttgtctcctactctgtgtaaatatttttccctccgggcaggggagccagggtagagcaaaggagacaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattctt

SEQ ID NO: 402594 - DNA, 1506 bp, Homo sapiens
caggagaatcgcttgaacctgggaagtggaggttgagtgagccgggaccgtgccattgtactccagcctgggtgacagagcgagattccgtctcaaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaagacagtccagagcttttcagccaatttgtctcctactctgtgtaaatatttttccctccgggcaggggagccagggtagagcaaaggagacaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttaaaaaaaaaaaacacaacaacaacc

SEQ ID NO: 402595 - DNA, 1185 bp, Homo sapiens
caggagaatcgcttgaacctgggaagtggaggttgagtgagccgggaccgtgccattgtactccagcctgggtgacagagcgagattccgtctcaaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaagacagtccagagcttttcagccaatttgtctcctactctgtgtaaatatttttccctccgggcaggggagccagggtagagcaaaggagacaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccaaccttccgaaaaaaaatggtcctctcggacggaacctggcttaaccaaggccggggttcctggcattaaggcgggagtgtgcgggggctggaggcgccacatcgttcaaaaggaccgcctttgggtgaccggtgaacctcctgggtaaagattagtt

SEQ ID NO: 402596 - DNA, 499 bp, Homo sapiens
gggacatcctcaaggttttgaacgaagactgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattctt

SEQ ID NO: 402597 - DNA, 1291 bp, Homo sapiens
cccggctgcaggaattcggcacgaggagagaactagtctcggtttttttttttaatttgttttgttttaaaataagttaaagacagtccagagcttttcagccaatttgtctcctactctgtgtaaatatttttccctccgggcaggggagccagggtagagcaaaggagacaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattctt

SEQ ID NO: 402598 - DNA, 1424 bp, Homo sapiens
caggagaatcgcttgaacctgggaagtggaggttgagtgagccgggaccgtgccattgtactccagcctgggtgacagagcgagattccgtctcaaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaagacagtccagagcttttcagccaatttgtctcctactctgtgtaaatatttttccctccgggcaggggagccagggtagagcaaaggagacaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattctt

SEQ ID NO: 402599 - DNA, 338 bp, Homo sapiens
ttttccttctttcctgctttcctgtcttccttttagcgaagatggttttctctggtggtatgctttagtttctttcttttaattttttgtatatcaatggtatgcttttcaatttgaggttatcatgagacttttaaatactatcttataatctattatttcaaactgctgacaacctaacacagattgcataaacaagaaaacacacaaaaataaaactaataaaatctctatgctttaacttcattcctccattttttaaacttttgattgtttctcattatgtcttattgtactatgtcatgaaaattttttatagtttttatttttgattggtt

SEQ ID NO: 402600 - DNA, 388 bp, Homo sapiens
atgtataattatgtgctacctggatatttttctcaaataacaatggccttatcaataacccaaggatatatcaagtttaaaaattttttaataactgaatttattttgtttcagttcagaaaaaccctattttcattgacagcataaactgaaatatattcttacatgaaatcatttattttgcatccttttagacatttgtccatgtatctaaaaatgaacttgtttttttcttttatggaaaacagtaaggagatctgattgtatgtataatgtattgaaatatggagctacataccaatattatacactagtatataaagagtttatttagtatttacttttcttgtcttgaatggtagtggaataataaatccctgaagaaagc

SEQ ID NO: 402601 - DNA, 297 bp, Homo sapiens
taagagatagggtctcactatgttaccgagtttggactcaaactcctgggctcaagtgatcctcccacctcagcctcccatgtagttaggactacaggcatgtgccaccgtacctggcaatttttaaaaactctaggtgacctttctaatcaatctttttccattgacaatcacctttttataaacgactgcagcactgattgtagtattcattttaaactgtacattctggtcatatgtgtgtatctatttctcactttttgtttagtttttttgagagagggtctggctgtgttc

SEQ ID NO: 402602 - DNA, 3212 bp, Homo sapiens
atccctgtttccccagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgacgctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaa

SEQ ID NO: 402603 - DNA, 3780 bp, Homo sapiens
tgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggaaaagctgtatagctccagtggtcctgagctccgccgctccctcttctcactgaagcagatcttccaggaggacaaagacctggtgcctgaatttgtgcattcagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgacgctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgaggctctggctacatcctcagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaa

SEQ ID NO: 402604 - DNA, 3835 bp, Homo sapiens
tgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggaaaagctgtatagctccagtggtcctgagctccgccgctccctcttctcactgaagcagatcttccaggaggacaaagacctggtgcctgaatttgtgcattcagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgacgctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtcttgtaagtaaccccccacaatcccactgcccacctgaaccccatcaaccccctccaaccctgctctgtccctgcagtgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaa

SEQ ID NO: 402605 - DNA, 3867 bp, Homo sapiens
tgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggaaaagctgtatagctccagtggtcctgagctccgccgctccctcttctcactgaagcagatcttccaggaggacaaagacctggtgcctgaatttgtgcattcagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgacgctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaatttttctaggttacacaaacatgatcatcgtccgccacaaacaacatgtgggccgtcttgggccaagtcgactttggcatggggcgcttttcctgcggcccctccc

SEQ ID NO: 402606 - DNA, 3830 bp, Homo sapiens
  misc_feature (3773)..(3773): n is a, c, g, or t
  misc_feature (3819)..(3819): n is a, c, g, or t
tgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggaaaagctgtatagctccagtggtcctgagctccgccgctccctcttctcactgaagcagatcttccaggaggacaaagacctggtgcctgaatttgtgcattcagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgacgctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaagaaaaaaaaaanacatgccggccgaattcgagctcacttggcccaatcgccctatagnggagcggattc

SEQ ID NO: 402607 - DNA, 246 bp, Homo sapiens
ctgctgaaggaatgcacagctgtagtgcagaccctgtgtctctctgccacccttcaagtggtaggtaagaggtcaggggtcttcatacattcgcctgccacctcttcctcagtctcacagctgttccctttgcccccagttggaggattgtgctctgcaagtgtctccctccggatactacctggacaccgagctgtccctggaagagcagcgggagatgctggagggcttctatgaagagatcag

SEQ ID NO: 402608 - DNA, 3761 bp, Homo sapiens
tgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggaaaagctgtatagctccagtggtcctgagctccgccgctccctcttctcactgaagcagatcttccaggaggacaaagacctggtgcctgaatttgtgcattcagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgacgctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaa

SEQ ID NO: 402609 - DNA, 4028 bp, Homo sapiens
tgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggaaaagctgtatagctccagtggtcctgagctccgccgctccctcttctcactgaagcagatcttccaggaggacaaagacctggtgcctgaatttgtgcattcagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctggataagtggctctccactcagccttataccctttgccatgttgcttctctgtgggcctcagcttcctgttctgcaaagtgagctggaagggagtgagtctgaggcctctgtaagcctataaggcacttcagtgcctgggcctggggccagggtcattctgcctagattctctctgggtccagccccagcagcccttccccttccccagcaacagctggcacaggtctggcctaagccccactcatatgtactgacctctctcctcagtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgacgctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaa

SEQ ID NO: 402610 - DNA, 1364 bp, Homo sapiens
gctccagccacctgggtgtgagctatgccctctgccagaaatgctctttcctctattggcctggccacacctactcagtctttgggtctgtttaactgccacttcccccagtaaaccttctgctccccattcacatcagatggacttgtgtctcttgcactagtctatgagatttggatgtctgtgtccttagggcccaagctggccactctggcccagaagcagcctcgggccatgtcttgtctacagggtgtggggggacagtatgtgcacccccttgctttctcaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaa

SEQ ID NO: 402611 - DNA, 3908 bp, Homo sapiens
tgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggcgctgcccttgggcgcgcagatacccgcggtgcaccgcctgctgggagcgccgctcaagttggaggattgtgctctgcaagtgtctccctccggatactacctggacaccgagctgtccctggaagagcagcgggagatgctggagggcttctatgaagagatcagcaaagggcggaagcccacgctgatccttcggacccagctctctgtgagggtcaacgctatcttggaaaagctgtatagctccagtggtcctgagctccgccgctccctcttctcactgaagcagatcttccaggaggacaaagacctggtgcctgaatttgtgcattcagaggggctgagctgcctgatccgtgtgggtgctgctgccgaccacaactaccagagctacatccttagagcgctcggccagctgatgctctttgtggatggaatgctgggggtggtggcccacagtgacactattcagtggctgtacacattgtgtgccagcctgtcccgcttggtggtgaagacagccctgaagctgctgttggtgtttgtagaatactccgaaaacaacgcaccgctgttcatccgtgcagtgaactctgtggccagcaccaccggtgctcctccctgggccaatctggtgtccatcctggaggagaagaatggcgctgaccctgagttgttggtgtacacggtcaccctcatcaacaagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacctggccccacaggccccgcctcaccggtaggccccacctcttccaccggccccgccctgctgacaggccccgcctccagccctgtgggccctccctccggtctccaagcttcagtgaacctttttcctaccatctctgtggcaccctcagctgacacctccagcgagaggagcatctacaaagcccggttcctggagaatgtggcggcagcagaaacagagaagcaggttgcgctggcccagggccgggcagagacacttgccggggccatgcccaatgaggcgggtggacacccagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagctccctacccgtgcacccaggctctctattggggacctggacttttcagatctaggggaggatgaagaccaggacatgctgaatgtagagtctgtggaggctgggaaagacatcccagctccctcacccccactgcccctgctctcgggagtacccccccctcccccacttccacctcccccacccatcaaaggccccttcccaccacctccacctctacctctggctgcccctcttccccattcagtgcctgacagctcagccctccccactaagaggaagacagtaaaacttttctggcgtgacgctgaagctggctgggggccatggagtctctgcaagccgctttgggccctgcgccaccctctgggcttcactggaccctgtctcagtggacacggcccgactggaacacctctttgagtctcgtgccaaagaggtgctgccctccaagaaagctggagagggccgccggacaatgaccacagtgctggaccccaagcgcagcaacgccatcaacatcggcctaaccacactgccacctgtgcatgtcattaaggctgctctgctcaactttgatgagtttgctgtcagcaaggatggcattgagaagctactgaccatgatgcccacggaggaagagcggcagaagattgaggaagcccagctggccaaccctgacatacccctgggcccagccgagaacttcctgatgactcttgcctccattggcggcctcgctgctcgtctacaactctgggccttcaagctggactatgacagcatggagcgggaaattgctgagccactgtttgacctgaaagtgggtatggaacagctggtacagaatgccaccttccgctgcatcctggctaccctcctagcggtgggcaacttcctcaatggctcccagagcagcggctttgagctgagctacctggagaaggtgtcagaggtgaaggacacggtgcgtcgacagtcactgctacaccatctctgctccctagtgctccagacccggcctgagtcctctgacctctattcagaaatccctgccctgacccgctgtgccaaggtggactttgaacagctgactgagaacctggggcagctggagcgccggagccgggcagccgaggagagcctgcggagcttggccaagcatgagctggccccagccctgcgtgcccgcctcacccacttcctggaccagtgtgcccgccgtgttgccatgctaaggatagtgcaccgccgtgtctgcaataggttccatgccttcctgctctacctgggctacaccccgcaggcggcccgtgaagtgcgcatcatgcagttctgccacacgctgcgggaatttgcgcttgagtatcggacttgccgggaacgagtgctacagcagcagcagaagcaggccacataccgtgagcgcaacaagacccggggacgcatgatcaccgagacagagaagttctcaggtgtggctggggaagcccccagcaacccctctgtcccagtagcagtgagcagcgggccaggccggggagatgctgacagtcatgctagtatgaagagtctgctgaccagcaggcctgaggacaccacacacaatcgccgcagcagaggcatggtccagagcagctccccaatcatgcccacagtggggccctccactgcatccccagaagaacccccaggctccagtttacccagtgatacatcagatgagatcatggaccttctggtgcagtcagtgaccaagagcagtcctcgtgccttagctgctagggaacgcaagcgttcccgcggcaaccgcaagtctttgagaaggacgttgaagagtgggctcggagatgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagcaaaataaaattttcttagctaatccaatagccccacactacacctctcatccctccctacaggcggccccctttggcccaggccactatcaacttcggcacgcttatgcatcgcggccgacttcacgccttttggccacattgcccttactggggggcgcctctacactccccg

SEQ ID NO: 402612 - DNA, 450 bp, Homo sapiens
aacctcagccttgccttcttatccccgccctccagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctacgaggtgggccgggccttacgctctgaggcggattggaaagagggaagagagaagcgcagtccccagcgccccaccccacctgcatacacgttaaccactttcttacatcctggtccgcctctgctagaacgccctgaaattggaggatggagacatcgaagaagccccaggcgctggtgggcggcgggaacgacgaaagccttcttctgaggagggcaagaggagccgccgttctctggaaggcgggggctgccccgcgcgtgccccggaacct

SEQ ID NO: 402613 - DNA, 2350 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacagtttaaaagcaagttcatgaattcgcgtgccgtgtgcacggagagaggccgtagttcctggggctggagctagtccaggaggacagtgaagatgtcgccttccttagtcccccggcctgtgagcaagaggaagctgcagaccactcgggccaccctcacccagacacctttagcaaacatacgacgacaaagaagattttgatgaagttcaaattagagtcagcgtgctcatcagaaagaaagcgcagccaacacgtttaggaacagaaacggattatgttgaagacaaacaatccattgcgtttgtgttcagtaacccaagcatcaaaggaacttgtggctggggagaaggcttgactatttgaaatctcaggactcctctgtccaggagctcccagactcccgtggagtggaagcctgggggctcgctgaagaagtcacgtgactggaacgtgcttaatgcttggctgtctggtaaggaaaataaagtggtgcattttgaataaaaataaaagctgattttaaatgtgtta

SEQ ID NO: 402614 - DNA, 426 bp, Homo sapiens
cgaaaaaaaaatttaaaagaaagttgatgtccgaaccaagggccgtattggcttttcttatactctagaacatacgacgacaaagaagattttgatgaagttcaaattagagtcagcgtgctcatcagaaagaaagcgcagccaacacgtttaggaacagaaacggattatgttgaagacaaacaatccattgcgtttgtgttcagtaacccaagcatcaaaggaacttgtggctggggagaaggcttgactatttgaaatctcaggactcctctgtccaggagctcccagactcccgtggagtggaagcctgggggctcgctgaagaagtcacgtgactggaacgtgcttaatgcttggctgtctggtaaggaaaataaagtggtgcattttgaataaaaataaaagctgattttaaatgtgtta

SEQ ID NO: 402615 - DNA, 5283 bp, Homo sapiens
gttgtacggtgttctagaggatcccgaacggtgctgcggttggagttggattaatcttggtgtcctgtgacagggattcggaggccatgggggagggctgagcagggagacaggagaaggcaagagggctgtgagaagcgtgggctgagtgacctgctccttggtgagggtgcgtgagcaggggttagcagatgacggttttagctgcccaagggcacgctggaagaggccaggttttggggaagaggatgaatctgtcttcaggcaggctgaatgcacttccgtgagttctaggtggacctggccaggaggcagctgggggccagcggctggagggcagcagagcgtctgggctggcacatgctctgaggcatgggcaaggagggccgtgagctgaggggccacgggcacaagtggtttaggaaaagggtgtggccattggccggggatgcagttccaaagtctagtaaggtgagcatggccaaccgcccgctggctttactgccattaggggccttgttgagacagctccccaaccctgtgcccacccgcatgtccccagaggaacatgaggcaaagggaggcgtccttcatcgaggagcgccgggcaagggagaaccggctcaaccagcagaagaagctgatcgacaagatccacacgaaggagaccagcgagaagtaccgccggggccagatggacttggacttcccctcgaacctgatgagcacggagaccctgaaattgaggagaaaagagacctccacagcagaaatggaataccagtcgggcgtgactgctgtggtggagaaggtcaagagtgctgtacggtgctctcacgtctgggacatcactagccgcttcctggcccagaggaacacggaggagaacctggagctgcagatggaggactgtgaggagtggcgggtgcagctgaaggccctggtgaagcagctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402616 - DNA, 5322 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctgaaaaaaaaaaaaaacaaaaaaaaaaaaaaaaaaaataaaagaaagggggagcgcagccgccgccgtcaataatatttctctctgactgagagggacgccaaagtaaggtgaggcccgacccccagcatttttttcttcaagaagggcggcgccgccaattatgatgcaggcgcctcttattattagcgaagggacgggccgcccgttctgttaacatcatgttcgtcatgtagcgtgaggaaaactagcgcgccaccttcgcgggaatactactcgtgcgagaggaagagaacccccatcacacctgcgtcgagctgggggtgaccacctaattctttgggagacaacaccctccccgacgacgggatattacgacagccgcctctggggctaaacctatactaaacctgttacgagtgtgtcgatcagcgcggcttgaaacaccagccaccgccactacttgctgccggctcggtcaataaaacagtttgtgacacagctgcgatattcattctagcgaaacaactattacacgcaggg

SEQ ID NO: 402617 - DNA, 4696 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacaatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402618 - DNA, 4891 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggtactggctactccccttcctggcaggccaggactgggtggcatgcggtcctgggaccagggctgtggcttcctgtgactccatggcgccccatccttgtgctcctcaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402619 - DNA, 4572 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgaggtctgtttacagaggctgggcaggggccgcttggctgtggggtgtgcgctgccccggcacctgcttgcctgcgcccccgctcaggtgagcccgaaggcaggagccgggaggcactcctcccaaacactccactcagaccataaagcactcctgtttcactctg

SEQ ID NO: 402620 - DNA, 3708 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggcgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402621 - DNA, 2455 bp, Homo sapiens
  misc_feature (44)..(44): n is a, c, g, or t
ctagaggatcccgcatcacccgggtatggtggtcatatgtcganattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402622 - DNA, 3821 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtgagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402623 - DNA, 4602 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcaggtaagcactcaccacgtggggtggagtggctgctggtctctcacctccttccaggtgtctcctgtgtagcaacgggtctccctcctaacccctgagaaagctgtggacctgctcggagattggctgctggcaagggcccagcgttctactgcacctgcctgctctgggtggcagagggtacagggtcctgagggctagacccagtcccaggagcccctccacctctgcggggaccccttgctcagtttcccccagtgtttttggttgtttttgtttgttgagataaggtcttgctgtgtggcccaggctggagtgcagtggcgcaatcatggctcactgcggcctcaaactccggggctcaggcagtcctcccacctgtctcccaaagtgctgggatgccaggcgtgagtcaccgaggtactcgctgttcacatctcacatttccctggtgcttgtgtcaaaaccaaggaaccaactttggcctacggactaaactcactttcctttgtagaaacaagggccaggccagctgtggctgcaaagtagcccagcaaatgatgaggcttgaacctcctcgccctgggctgccctgattgggtctgggggacctgaacctcctcgccctgggctgccctgactgggtctgggggacctgaacctcctcgccctgggctgccccagctgggtctggggacctgaacctcctcgccctgggctgccccgcctgggtctggggacctgaacctcctcgccctgggctgccccgcctgggtctggggacctgaacctcctcgccctgggctgccccgcctgggtctggggacctgaacctcctcgccctgggctgccccagctgggtctgggggacctgaacctcctcgccctgggctgccccagctgggtctgggggacctgaacctcctcgccctgggctgccccagctggatctgggggacctgaacctcctcgccctgggctgccccgcctgggtctgggggacctgaacctccttgcctgggctgccccgcctgggtctgggggacctgaacctcctcgccctgggctgccccagctgggtctgggggacctgtacctcctcgccctgggctgccccgcctgggtctgggggacctgaacctcctcgccctgggctgccccgactgggtctgggggacctgaatctcctcaccctgggctgccccagctgggtctggggacctgaacctcctcgccctgggctgccccagctgggtctgggggacctgaacctcctcgccctgggctgccccgactgggtctgggggacctggggcccagctgcagctgcagcagccttggtctttctccagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctggggaggcccctccttcctgcagagccgtcccctcatcactgggttgattactccttagagagctccccactgctcagctgctccattccctaatggtttgccctccaaacccttccaaagcctcccagggagagaacgggaccctggacagagtcttgagctggaagcgtagggctgagctgtgtgtgactatccttttgctatggatgtgttcaagcagatctgatgtcctcgcctgtctcagcagcgggacccctgtttcctctttgtcttgcccctggattgcctggaagcaaatttcaggccttctttatgtcacctaaaaatatttcaaacacatctctaaaaaaatcagttgtttttttaacctgaccgtagtacctaatgtaataccgcatgttaaactcacagaaggtttttcttggagaaataagccacaataacaaattgaaaaaataaaattcccaaagagtt

SEQ ID NO: 402624 - DNA, 3474 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcctgagggcgacccaaaggtgaccacatgagatgtggatctactgtgaatctgtgtcccaggaatattgctggatgagagagccaaatgaaatcggtaaaggaggtgtacattttctgggacatacttgagagagactgaccagtcctctcgcaggccccgaggtctggcacttgctgagaacgggctccttacagctatgcggggaagcagcatccttacaggacgtgcgagctggccagcagaaggagcggttccccacgcagcatcagcgcctgagcctgggctgccggtgctggacgcgctgctccgcggtggtctgccctggagggatcactgagcgtggcggacgcagtcggcagggaagacccaggtgggcgtgcagcttcctgctggtgtgcagggtcccgggcaagaccgaggctggggggggagcccgctacatctgccgggaaacgcgcttccggaaagcgctggaggagtaggccagaggcgggctggcctggggttcaggagactgttcaaacgcgatgggggcaattaacgggggggggggggcctgtggggtggtaacaggcctgggacaggaagcgg

SEQ ID NO: 402625 - DNA, 3253 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctggggaggcccctccttcctgcagagccgtcccctcatcactgggttgattactccttagagagctccccactgctcagctgctccattccctaatggtttgccctccaaacccttccaaagcctcccagggagagaacgggaccctggacagagtcttgagctggaagcgtagggctgagctgtgtgtgactatccttttgctatggatgtgttcaagcagatctgatgtcctcgcctgtctcagcagcgggacccctgtttcctctttgtcttgcccctggattgcctggaagcaaatttcaggccttctttatgtcacctaaaaatatttcaaacacatctctaaaaaaatcagttgtttttttaacctgaccgtagtacctaatgtaataccgcatgttaaactcacagaaggtttttcttggagaaataagccacaataacaaattgaaaaaataaaattcccaaagagtt

SEQ ID NO: 402626 - DNA, 4623 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcaggtaagcactcaccacgtggggtggagtggctgctggtctctcacctccttccaggtgtctcctgtgtagcaacgggtctccctcctaacccctgagaaagctgtggacctgctcggagattggctgctggcaagggcccagcgttctactgcacctgcctgctctgggtggcagagggtacagggtcctgagggctagacccagtcccaggagcccctccacctctgcggggaccccttgctcagtttcccccagtgtttttggttgtttttgtttgttgagataaggtcttgctgtgtggcccaggctggagtgcagtggcgcaatcatggctcactgcggcctcaaactccggggctcaggcagtcctcccacctgtctcccaaagtgctgggatgccaggcgtgagtcaccgaggtactcgctgttcacatctcacatttccctggtgcttgtgtcaaaaccaaggaaccaactttggcctacggactaaactcactttcctttgtagaaacaagggccaggccagctgtggctgcaaagtagcccagcaaatgatgaggcttgaacctcctcgccctgggctgccctgattgggtctgggggacctgaacctcctcgccctgggctgccctgactgggtctgggggacctgaacctcctcgccctgggctgccccagctgggtctggggacctgaacctcctcgccctgggctgccccgcctgggtctggggacctgaacctcctcgccctgggctgccccgcctgggtctggggacctgaacctcctcgccctgggctgccccgcctgggtctggggacctgaacctcctcgccctgggctgccccagctgggtctgggggacctgaacctcctcgccctgggctgccccagctgggtctgggggacctgaacctcctcgccctgggctgccccagctggatctgggggacctgaacctcctcgccctgggctgccccgcctgggtctgggggacctgaacctccttgcctgggctgccccgcctgggtctgggggacctgaacctcctcgccctgggctgccccagctgggtctgggggacctgtacctcctcgccctgggctgccccgcctgggtctgggggacctgaacctcctcgccctgggctgccccgactgggtctgggggacctgaatctcctcaccctgggctgccccagctgggtctggggacctgaacctcctcgccctgggctgccccagctgggtctgggggacctgaacctcctcgccctgggctgccccgactgggtctgggggacctggggcccagctgcagctgcagcagccttggtctttctccagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctggggaggcccctccttcctgcagagccgtcccctcatcactgggttgattactccttagagagctccccactgctcagctgctccattccctaatggtttgccctccaaacccttccaaagcctcccagggagagaacgggaccctggacagagtcttgagctggaagcgtagggctgagctgtgtgtgactatccttttgctatggatgtgttcaagcagatctgatgtcctcgcctgtctcagcagcgggacccctgtttcctctttgtcttgcccctggattgcctggaagcaaatttcaggccttctttatgtcacctaaaaatatttcaaacacatctctaaaaaaatcagttgtttttttaacctgaccgtagtacctaatgtaataccgcatgttaaactcacagaaggtttttcttggagaaataagccacaataacaaattgaaaaaataaaattcccaaagagttatgttaaaaaaaaaaaagaaa

SEQ ID NO: 402627 - DNA, 2346 bp, Homo sapiens
  misc_feature (67)..(67): n is a, c, g, or t
  misc_feature (2303)..(2303): n is a, c, g, or t
  misc_feature (2334)..(2334): n is a, c, g, or t
  misc_feature (2340)..(2340): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctnaaatggccctgggccccgtaccttccctgantctttnccctgg

SEQ ID NO: 402628 - DNA, 819 bp, Homo sapiens
cccagaggaacatgaggcaaagggaggcgtccttcatcgaggagcgccgggcaagggagaaccggctcaaccagcagaagaagctgatcgacaagatccacacgaaggagaccagcgagaagtaccgccgggtaagccccaggccagggcctggctggctgcccatccccatgacagctgggtggacacaggctcagggccaccactcagggcccactccctgccaaggatgtctcatcccttccccgcccccacctcccatcagggccagatggacttggacttcccctcgaacctgatgagcacggagaccctgaaatgtaagcgctcagctccccacctgcccccagccagggtcccaaggagaggctggcactgattcaggccaacggatcaagtcaccctgaggccaggtgtgacatgtggtcgccagggtgaagggaaggacaggtccctgcctctccctccagaggctgagagcctgtagccaaatgtggcctcagagatgctggccccagcacccaagggccctgcaccaagggcccagtccccagtgactctgcagaggatgagcatcctgacccctaagctgcctctgagaagcaccaccgggcccacagtgctcacagtgctgcgccactcactccgggtccacctctgctctggggctgcctggggcgtccctgcagggctgggctgaggagggagcaggttggggcgggggcaggcatctctgaaggatgcctgtgtcttgggtggccgccccagcagctgggcaggtacagaggtgtctgacagccttacacagagcccctgagc

SEQ ID NO: 402629 - DNA, 231 bp, Homo sapiens
acatctctaaaaaaatcagttgtttttttaacctgaccgtagtacctaatgtaataccgcatgttaaactcacagaaggtttttcttggagaaataagccacaataacaaattgaaaaaataaaattcccaaagagttttcttccagtcgtcagatatttggtcagtattcagagtaggatccagagttcacacattacatttggttgacaagtctgtagatttctctttg

SEQ ID NO: 402630 - DNA, 733 bp, Homo sapiens
  misc_feature (3)..(3): n is a, c, g, or t
  misc_feature (30)..(30): n is a, c, g, or t
ccnctaagggaccaaagctgagctccacgncgtgccgccgctctagccgggcggatccccgggctcaggatttcgccacgaggtgccagcctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402631 - DNA, 4782 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402632 - DNA, 5252 bp, Homo sapiens
acttcgctgcttcataaccaagcgtcctacttgcctgccttaagggtctaccttgcaaaggcacatgctgcttttaaagtcctttgtggtcattaataagtatctatggctttcctcttcagtgataagagctgttgggtgcgtgagcaggggttagcagatgacggttttagctgcccaagggcacgctggaagaggccaggttttggggaagaggatgaatctgtcttcaggcaggctgaatgcacttccgtgagttctaggtggacctggccaggaggcagctgggggccagcggctggagggcagcagagcgtctgggctggcacatgctctgaggcatgggcaaggagggccgtgagctgaggggccacgggcacaagtggtttaggaaaagggtgtggccattggccggggatgcagttccaaagtctagtaaggtgagcatggccaaccgcccgctggctttactgccattaggggccttgttgagacagctccccaaccctgtgcccacccgcatgtccccagaggaacatgaggcaaagggaggcgtccttcatcgaggagcgccgggcaagggagaaccggctcaaccagcagaagaagctgatcgacaagatccacacgaaggagaccagcgagaagtaccgccggggccagatggacttggacttcccctcgaacctgatgagcacggagaccctgaaattgaggagaaaagagacctccacagcagaaatggaataccagtcgggcgtgactgctgtggtggagaaggtcaagagtgctgtacggtgctctcacgtctgggacatcactagccgcttcctggcccagaggaacacggaggagaacctggagctgcagatggaggactgtgaggagtggcgggtgcagctgaaggccctggtgaagcagctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402633 - DNA, 4831 bp, Homo sapiens
acttcgctgcttcataaccaagcgtcctacttgcctgccttaagggtctaccttgcaaaggcacatgctgcttttaaagtcctttgtggtcattaataagtatctatggctttcctcttcagtgataagagctgttgggtgcgtgagcaggggttagcagatgacggttttagctgcccaagggcacgctggaagaggccaggttttggggaagaggatgaatctgtcttcaggcaggctgaatgcacttccgtgagttctaggtggacctggccaggaggcagctgggggccagcggctggagggcagcagagcgtctgggctggcacatgctctgaggcatgggcaaggagggccgtgagctgaggggccacgggcacaagtggtttaggaaaagggtgtggccattggccggggatgcagttccaaagtctagtaaggtgagcatggccaaccgcccgctggctttactgccattaggggccttgttgagacagctccccaaccctgtgcccacccgcatgtccccagaggaacatgaggcaaagggaggcgtccttcatcgaggagcgccgggcaagggagaaccggctcaaccagcagaagaagctgatcgacaagatccacacgaaggagaccagcgagaagtaccgccggggccagatggacttggacttcccctcgaacctgatgagcacggagaccctgaaattgaggagaaaagagacctccacagcagaaatggaataccagtcgggcgtgactgctgtggtggagaaggtcaagagtgctgtacggtgctctcacgtctgggacatcactagccgcttcctggcccagaggaacacggaggagaacctggagctgcagatggaggactgtgaggagtggcgggtgcagctgaaggccctggtgaagcagctggagctggaggaggccgtgctcaagttccgccagaagcctagctccatcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcgacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402634 - DNA, 5352 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctgaaaaaaaaaaaaaaaaaaaaaaaaaaaaaaaaaaaaaaaaaaaacaaaaaaaaaaaaaaaaaaaataaaagaaagggggagcgcagccgccgccgtcaataatatttctctctgactgagagggacgccaaagtaaggtgaggcccgacccccagcatttttttcttcaagaagggcggcgccgccaattatgatgcaggcgcctcttattattagcgaagggacgggccgcccgttctgttaacatcatgttcgtcatgtagcgtgaggaaaactagcgcgccaccttcgcgggaatactactcgtgcgagaggaagagaacccccatcacacctgcgtcgagctgggggtgaccacctaattctttgggagacaacaccctccccgacgacgggatattacgacagccgcctctggggctaaacctatactaaacctgttacgagtgtgtcgatcagcgcggcttgaaacaccagccaccgccactacttgctgccggctcggtcaataaaacagtttgtgacacagctgcgatattcattctagcgaaacaactattacacgcaggg

SEQ ID NO: 402635 - DNA, 4757 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgaggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402636 - DNA, 4788 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaacacccaacgcccccgttgagccacaacaaaaatcaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402637 - DNA, 4644 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 402638 - DNA, 3923 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcacagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtgggtgggggcaccagagtgcggtcagcctgctggagtttgggtagaacgtgggcctcctcccag

SEQ ID NO: 402639 - DNA, 2910 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcctcgggtggagcgggatcctctagatct

SEQ ID NO: 402640 - DNA, 4628 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcaggtaagcactcaccacgtggggtggagtggctgctggtctctcacctccttccaggtgtctcctgtgtagcaacgggtctccctcctaacccctgagaaagctgtggacctgctcggagattggctgctggcaagggcccagcgttctactgcacctgcctgctctgggtggcagagggtacagggtcctgagggctagacccagtcccaggagcccctccacctctgcggggaccccttgctcagtttcccccagtgtttttggttgtttttgtttgttgagataaggtcttgctgtgtggcccaggctggagtgcagtggcgcaatcatggctcactgcggcctcaaactccggggctcaggcagtcctcccacctgtctcccaaagtgctgggatgccaggcgtgagtcaccgaggtactcgctgttcacatctcacatttccctggtgcttgtgtcaaaaccaaggaaccaactttggcctacggactaaactcactttcctttgtagaaacaagggccaggccagctgtggctgcaaagtagcccagcaaatgatgaggcttgaacctcctcgccctgggctgccctgattgggtctgggggacctgaacctcctcgccctgggctgccctgactgggtctgggggacctgaacctcctcgccctgggctgccccagctgggtctggggacctgaacctcctcgccctgggctgccccgcctgggtctggggacctgaacctcctcgccctgggctgccccgcctgggtctggggacctgaacctcctcgccctgggctgccccgcctgggtctggggacctgaacctcctcgccctgggctgccccagctgggtctgggggacctgaacctcctcgccctgggctgccccagctgggtctgggggacctgaacctcctcgccctgggctgccccagctggatctgggggacctgaacctcctcgccctgggctgccccgcctgggtctgggggacctgaacctccttgcctgggctgccccgcctgggtctgggggacctgaacctcctcgccctgggctgccccagctgggtctgggggacctgtacctcctcgccctgggctgccccgcctgggtctgggggacctgaacctcctcgccctgggctgccccgactgggtctgggggacctgaatctcctcaccctgggctgccccagctgggtctggggacctgaacctcctcgccctgggctgccccagctgggtctgggggacctgaacctcctcgccctgggctgccccgactgggtctgggggacctggggcccagctgcagctgcagcagccttggtctttctccagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctggggaggcccctccttcctgcagagccgtcccctcatcactgggttgattactccttagagagctccccactgctcagctgctccattccctaatggtttgccctccaaacccttccaaagcctcccagggagagaacgggaccctggacagagtcttgagctggaagcgtagggctgagctgtgtgtgactatccttttgctatggatgtgttcaagcagatctgatgtcctcgcctgtctcagcagcgggacccctgtttcctctttgtcttgcccctggattgcctggaagcaaatttcaggccttctttatgtcacctaaaaatatttcaaacacatctctaaaaaaatcagttgtttttttaacctgaccgtagtacctaatgtaataccgcatgttaaactcacagaaggtttttcttggagaaataagccacaataacaaattgaaaaaataaaattcccaaagagttaagagaaaacaaacaacacaaaccgg

SEQ ID NO: 402641 - DNA, 2522 bp, Homo sapiens
  misc_feature (67)..(67): n is a, c, g, or t
  misc_feature (2508)..(2508): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctggggaactaccgggacatgggcgagcaccgagtcatcctgccggacagtccctgcattgngatcctgtagttcg

SEQ ID NO: 402642 - DNA, 2353 bp, Homo sapiens
  misc_feature (67)..(67): n is a, c, g, or t
cgcccaaaccagcttctccacttcttcggaccagtgctcagagccagagaccaagtggtcctccatntccagcttcgaagccggggacggggacagctcccacgaggaccgagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggagctggaggaggccgtgctcaagttccgccagaagcctagctccatcaggtgccccgggcttccggggctgcgggccacccaccccagtctcacaaaggccccgggctgcagccaggctgggagctgggagtatacccactgccaacaagcctgtgtgtcccacagaggggccaggggactccacttgcacacacctgagcttctgagtccctgattctggcacagcacccaactcaggactgggctcctgggtggcccaccatggctctcgggcctgtgcccctcactgctgtgtccctattgccttctgcagcttcaagtccgttgagaagaaaatgacagacatgctaaaagaggaagaagagaggctccagctggcgcacagcaacatgaccaagggccaggagctgctgctgaccatccagatgggcatcgacaacctctatgtccggctgatgggcattaacttgcctgcgacccaggtaccgggagtgaggctgagctgccacacaccaggtccctgggcagggccagaggggagatgagaccctcctcccggcctacagagagaagtggtgctctccaacaccctcgatttgaacagcaagctggcgtactgcgaggggaagctcacgtacctggctgacagagtgcagatggtgtccaggaccgaggagggcgacacaaaggtgagggacaccctggagtcctcgactctgatggagaagtacaacaccaggatcagctttgagaaccgggaggaggatatgatcggaggaggcatgccatgccagacgggcccggaggagaggcaccagggctggagcagggaggagcgcggtgaagacaccttccagttccccgacatggaccacagctacgtcccttcgcgcgccgagatcaagaggcaggcgcagcggctaatcgaggggaagctcaaggcggccaagaaaaagaagaagtagccccgccgccccgctccctgctttgctacacaaataaacatttttccaggactgctgcggacgctggggcgaccggggtctcggagaggagcacgggacacgcaggatcgggggaggttctgcgtaaggaggcagcccgggcccggaactgcgcgccagaaccgcgtgcgcatgcgccgaccgcgcgcgccgcgcccccgcggccctcgcggcgccccgtagccgcgcacccctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaacggcctggatgtgtcgacgtgtacagaactgcacgggtgtcagcccg

SEQ ID NO: 402643 - DNA, 324 bp, Homo sapiens
gagaagagaggcagtagaaaccgtggttagaaaggtgatttggggtggacccaagaatggccattgatggcctttgtggacgaccttgaaacctgggctgagaaccttggcttttattctgtccacattggggagctcccagaagctttgaggaggggtgatatggcttggctgtgtccccactcaaatctcatcttgaattgtagctcctataattcccacatctcgtgggagggacctggtgggaggtaattgaatcatgggggcagatcgttctcatgctgttcccatgatagtgaataagtctcatgagatctgatggtt

SEQ ID NO: 402644 - DNA, 705 bp, Homo sapiens
cccgagtagctgggattacagtcatgcatcaccatgcctggctaattttgtatttgtagtggagatggggtttctccatgttggtcaggctggtctcaaacacctgacctcagctgatctgcctgccttggccttccaaagtgctgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgc

SEQ ID NO: 402645 - DNA, 812 bp, Homo sapiens
cccgagtagctgggattacagtcatgcatcaccatgcctggctaattttgtatttgtagtggagatggggtttctccatgttggtcaggctggtctcaaacacctgacctcagctgatctgcctgccttggccttccaaagtgctgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccacctt

SEQ ID NO: 402646 - DNA, 1954 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctccctgaatatatgttcaagtgggtgtgcccatagggcctgggcacgtgtctctagcaaaaccagggcctgagcataagaatgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgc

SEQ ID NO: 402647 - DNA, 1934 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctccctgaatatatgttcaagtgggtgtgcccatagggcctgggcacgtgtctctagcaaaaccagggcctgagcataagaatgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgc

SEQ ID NO: 402648 - DNA, 2266 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgaggtaagccctcaccctaggtaagaaccatgtgtgaatggctctagtgtccaacacaggccaggtagaccccttcctgtaaaattctggggctgggcccagggcccttgggtgttatcttcctcctgggtattctgtgggatttgaggcatctctgttgtggggctacatcaggccctaacctcatgtttcataagccatctgagaatgttgttggtctcagctggagggcccctagcccaggttggcctctctggagcctgaagggcactgctggggagagaccatggccactgacccctccttctggagcagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctccctgaatatatgttcaagtgggtgtgcccatagggcctgggcacgtgtctctagcaaaaccagggcctgagcataagaatgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgc

SEQ ID NO: 402649 - DNA, 1840 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctccctgaatatatgttcaagtgggtgtgcccatagggcctgggcacgtgtctctagcaaaaccagggcctgagcataagaatgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgc

SEQ ID NO: 402650 - DNA, 2061 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctccctgaatatatgttcaagtgggtgtgcccatagggcctgggcacgtgtctctagcaaaaccagggcctgagcataagaatgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccacctt

SEQ ID NO: 402651 - DNA, 1702 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctccctgaatatatgttcaagtgggtgtgcccatagggcctgggcacgtgtctctagcaaaaccagggcctgagcataagaactgggacccttctaggcagggtgcagtggctcacgcctgtaatcccagcactttgggaggcccaggcaggcggatcacctgaggtcaggagttcaagaccagcctgaccaacctggagaaaccccgtctctactaaaaatacaaaaaattagctgggcgtggtggtaggcacctgtaatcccagctacttgggaggctgaggcaggagaatctcttgaacccgggaagtggaggttgcggacctgagatcatgccattgcactccagcctgggcaagaagagcgaaactccatcttaaacaaacaaaca

SEQ ID NO: 402652 - DNA, 835 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatgtggcctagacagaacaggcatgcaggcgacacttggaatgcacaggaaatacacttcagcctctggtgccccaaaccaagtctgggtggcacagaaagccaacatctggctaggagcaaccattcaagtgtagagaagcaagcttc

SEQ ID NO: 402653 - DNA, 291 bp, Homo sapiens
gaggactccgtctgcacagcaggagaacttaggtagtctgactgcctctttaggtctctgtgggctccctaaacagggttttcccagtgtctgaggcccagcggcccttctctctgctcctaggaccttggaatctggtcccagagctgtccactttgtctcactcagggcagtacatctttgctttgcagagcccctccgtgacctttcccaagtggctctcccacccagtgccctgtgagcaacctgcactcctccgtgaggtaagccctcaccctaggtaagaaccat

SEQ ID NO: 402654 - DNA, 1626 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgatctgcctgccttggccttccaaagtgctgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgc

SEQ ID NO: 402655 - DNA, 2046 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagctggagggcccctagcccaggttggcctctctggagcctgaagggcactgctggggagagaccatggccactgacccctccttctggagcagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctccctgaatatatgttcaagtgggtgtgcccatagggcctgggcacgtgtctctagcaaaaccagggcctgagcataagaatgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgc

SEQ ID NO: 402656 - DNA, 1966 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctccctgaatatatgttcaagtgggtgtgcccatagggcctgggcacgtgtctctagcaaaaccagggcctgagcataagaatgggattacaggcatgagccaccgcgcccggcctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattccctcctgtgcagcacaaccccggcaaaacaacccaacccacgaggaccatcgggggcagagtcgttggagactg

SEQ ID NO: 402657 - DNA, 677 bp, Homo sapiens
gaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgaggtaagccctcaccctaggtaagaaccatgtgtgaatggctctagtgtccaacacaggccaggtagacccaggctggctagacccaggggtgatcctctag

SEQ ID NO: 402658 - DNA, 147 bp, Homo sapiens
aattatgaataaagatgttataattatctgtgcagacttttgtgtgtatatacgttatttcccacaaattcatatatttacttcattgttagtcagtggagtacatacacacatatagatgtctctgagtcaccttaagtcacataa

SEQ ID NO: 402659 - DNA, 572 bp, Homo sapiens
aggggaggcttctctggagcaaggaggcgcagcagggtgctcctggcggagggatcggcgggtgcaaaggccccggcgtgagacgggcagtgaggggtggatggggcaaaggctcagcccaggcactgggagcctgggtagcaggaaaggaccttctctggtgccctgaagggcaccgcagagaccctgtggaggccaaagctgaggcagcccaaggctttctctttcccagcagggcatcggttgcagcagtgaccttgaccttcaggttttggggtacacaagggcagagactgcagcactgtgccagactcaggagaggaccatcgtccctaccccacacctttagggaaagcctcctctttcagaatccgactgatgatctcctgctttctgagcttctgctcctcctcaaaggccctgcgtggagtcgcttctcagatgagtgcaagaggtcccctgcctccaccttgccccagactgcacttcccgggtgcctcctacatgccaggcctgcgccaggctaagggatgtataggcggtggagctgctgccaggacccccccgcccag

SEQ ID NO: 402660 - DNA, 410 bp, Homo sapiens
ggattataagtaaccagccagaagagtttgctgttacacgtcatccaagagcatgcagaatgaactgaggccttcaggtcattggtttaagaatttatctgtaatatgaaagcctaaaatgcagacagttctatgtatctttttacttgttttcacctttctttcacctgaactactgctacagtacagcatttgacatttggagctgtttctacatatgattcttttaattaccataaaatttcatgcttgaatatttatactttttaacatttattttatgtttttccatatgttgaaggcttatctctggaatagagtgaaaagctgtaaggactacagtattggttttaaagtcagtgccaagcgcatggaaatgctgaataaatgttcgttttaatgtgttggtt

SEQ ID NO: 402661 - DNA, 362 bp, Homo sapiens
ccttggctgtgtcaaaaacaagtttagaaccctagtgttttcagggggtaactaaatttaaaaagccttaaatgggctgggtgtggtggctcacacctgtaatcccagcactttgggaggccaaggtgggctgatcacgaagtcaggagttcaagaccagcctggccaacatagtgaaaccctgtctctactaaaaatacaaaaaaaaaaaaattagccaggtgtggtggcaggcagctgtagtcccagctacttgggaggccgaggcaggagaattacttgaagccgggaggtggaggttgcagtgagctgaaatctcacaactgcactccagctcaggtgacagagtgagactctgtctc

SEQ ID NO: 402662 - DNA, 509 bp, Homo sapiens
ctgcttcctgggttcaagcaattctgccgcagcctcccgagtagctgggattacaggcacccacctccacacccggataatttttgtacttttagtagagatagggtttcaccatgttgtccaggctggtcttgaacttctgacctcctgatctgcctgtcttggcctcccaaagtgctgggattaaaggcatgagccactgcgcctggcccacacctgggtaatttttgtatatttaatagagacggagtttcactgtgttggccaggctggtctcacactcctgacctcaggtgatctgcctgcctcggcctcccaaagtgctgggattacagacctgagccactgcacctggcttccattacagatttttactttgaattattttatctaatttgaagctaatatagcatataataaaaattcaggagaaaaaaggttatttttaaatcttttttgagagagtccattctttagcctgaaagtaaagtgcatatgtaagcacagtt

SEQ ID NO: 402663 - DNA, 469 bp, Homo sapiens
aagttttcagctattagttggtgatttacttggtacctcatttaattttcctgtcccctcttcaacttggactcaatcactccacaggtctctaagactcttcattttctttaagatttttcactcttttattcagaatggacaatttctattgctctgtgttctgtttctaatctttgaataagctcaaaagtattttttaaatttccttatcttcttattgtttcgtaatttccatgtctttgctgaggttccacagctcttcattcatgattagaatattttcctttacccccatgaacagatttataatggctgcctttaaacatcctgaattacaacatcttaaatatcttaggatcacttctactgcctgctttttaaattgtgtatggatctcattttcgtgtttcttcacacgtctcatgaattttaatgttgtgtactaaaactgtaaagaatcattata

SEQ ID NO: 402664 - DNA, 537 bp, Homo sapiens
gatgggaatcatagcatatggatggtatttgaaagcttggttttaggtgacatgatcttgagaccaaatatggagtgagaaaagaaggccaagtttctagccctaacggattctagcacttatagaactaggagaagaagcatgagtttgtaaggaagatgaggagcagaagtggggaagggccaatagttactcttctaataatctagcctagggacacagaaatgaggatctagatttatgcacgaagaggctcattgtagcatttaccgtagtgaaaaattagcttcaacctcaaatgtcaaaaaatagatgtttacatacgttgtgacacattaattctggggaataaatgaagtcaaataagatgcttttgaaaattataacattaagtgaaatgatacggtttggatctgcatccctaccaaatctcatgttgaattatagtctccagctttggaggtgaggcctgctgagaggtggttggatcatgggggtggatatctcaggaatggattagcaccatccccttggtgc

SEQ ID NO: 402665 - DNA, 410 bp, Homo sapiens
aagcacatgaagtgaggctacttttcttactactcatcagggaagggcaaattaaaacacaatgaatggcacggtggctcacgcctgtaaacccaccactttgggaggccgaggtgtgggaattacctgaggtcaggagtttgagaccagcatggccaacatggtgaaaccctgtctctactaaaaacacaaaaattagccaggcatggtggtacacacctgtcatcccagctactcaggaggctgaggcagaagaaacccttgaacccaggaggtgaaggctgcagtgagccgagatcatgccactgcactccagcccaggtgagagagtgagtgagactctgtctcaaaacaaaaaacaaaaccaaaaaaacacaatgaggtacaattacgcacccatctgaatgttt

SEQ ID NO: 402666 - DNA, 394 bp, Homo sapiens
tactattttttttgactgtgttacatgcacgttttaagattataagctttagtatctgatggatttgggttcagatccttgcctcagacttcttggggtttttaatgggaatgaaaattgtacagtgttgtaagaattaccaacaatataaataaagcatcttgggtttgttaaatttttggtaaatggtggttggaatcattttttagtgttgcgtagaccctacaagttttgagctgtgattcctcctcactgtgacagtctccattgttggctttgattacactgtaccatcctggttgttctgccagcccattgataacttttaccatttgctggcttttattgctatccccactctattaaagtatgcattcaaatgcctttcttttct

SEQ ID NO: 402667 - DNA, 506 bp, Homo sapiens
ggctttgaaatcctgacatccgggttatatctcagttctatcatttgctcggcatgtggcccctaaacaagttaaccaccactctgagcctcagtttcctcaagtgtaaaataggaaagataaaatctacctgcacattaaaagtgacacagtgtatctaattcatgggtcaattatggagaggagtgtgttgaaatatttcactatgatggtggattggttgatttcttcttgaagttctgataatgtatacggagaacttagcacagggcaggcatggtcggcactaaataaacacacacatttaaccggcggaaagctaacgtagggtgatagatacaacattttatttttcacagccataaaaaagaaagaaatcatgtcctttgcagcaacatggatgcagctggaggccattatcctaagcgaattaacacaggaacagaaaaccaaatattgcatattctgacttacaagcgggagctaaacactgggtactcgtggac

SEQ ID NO: 402668 - DNA, 511 bp, Homo sapiens
gaaggcacgtgctctgcagagctctagctgccttggctctccctgagctcccagacttcactcatggcctaattttcaatgacagaacgtaggttttatcgtgaggatgcagacacaaccacaattacgtatgtcaacataacttcataaatatgtaactgtaacttattggtaacatcagtgcaagatgattaaagcttcatgtgtagtattttatcaacaaacagattctgaaagcttatggacatgcgcaatagttgattcagcttcaatcaataagaacataaatatggcaatttgaaaacactatgtatatacctactcacatatatattatacttacgatatatacttatatgtagtatataataatattacatataaaaatgttataaaaataaatgctaaagtaaataaaaaaagagccactaatatgttaactattgttaaataatagctaaaataatacagattattaaattattttaatacttacttgccataataatct

SEQ ID NO: 402669 - DNA, 257 bp, Homo sapiens
agctacacgggaggctgagacaggagaactggttgaacctggaaggtggaggttgcagtgagccaagattgtgccactgtactccagcttgggtgacagagcaaaactctgtctcaaaaaaaaagaaaaaaaaaagaaaatggattacttatacccaatgctaccatctttgtgtctacctttccagacttttctgtgcttacatatacataaagatatagaaatatacattttcaataaaaatagcatcatgcttt

SEQ ID NO: 402670 - DNA, 468 bp, Homo sapiens
ctgagcccttcgctgccggccctggacttagtggacggagcgggagattcccgcccaggggaagaggttcccacggagggcatgcggtcgcgggtgcctttggattcgtgtgttcagggaggccagataatctcctccccgcgccggagcccctgttcctcatttctagcattttaaaaaaggtcaagaatacagtgaatccggctgggggctgccggctgggtgacgcgcctctggctagaccgaatggcacaggctgagcccgggggtgcggaccggtgggcacggagaagggtccctcggcgcggactcgactgcaggagccgcggcgccgggggtggggggcgtgtgccgctcgcgagggggccggaggacttgacagatcgcagcgaaagaaaacattaaaccaaaacaaaacccaccgattccccacgtcgttcagcaaagacatcgtgggtggagccagga

SEQ ID NO: 402671 - DNA, 486 bp, Homo sapiens
cgtccagaaatgcagacacagccgccaggcaaagcacctgctcctcccatcgcccccctggcaaaatccccagtctgggtccacggagagtcccaggctgcagctctgtgccaagcagccgaggggaacagagcacgggctcgccagctgcccccaggtgtggagacgtgacgcacacagaggcctcccaggaggagcagccatgactccgggggacacatgggccagcttcaaccccagagcagggcacagcaaaagccaaggtgagggacaggagagcagtggtgcgtccaggcaagacaggcatcccgtcagccgctgggtagaaaggcagagggaggcctggggagcccccaggagcagcagtgcaggtggagtaaaggttgctgcgaccacagaaagggaacccgagtttaaaataaagactggaaaggcgtgaagcaaaggaaagaggctttctgctctcgttcagcatccttttcccag

SEQ ID NO: 402672 - DNA, 479 bp, Homo sapiens
gttatgtcaaatgctgaaacatcaactgtggcttcctctaggcattgcaccaaaatttctttcaagtaactgtggaagaaacagacatcgcttctctaatccacagtgtgtccattttagagggtaacactcagaaagccatcttgtttctctcatttctaaatgattacagagcacccagtgttgcccttttgcaccaattacataaaatagtacctatgagctgaatggtgaggagtctaaataccccggggcacggtggtgacagagtaacactctccctaagatgtctgcatgctaatccccagaacctctgcaaacattaggctacacagccaagggaattgaggttactaatcagatgggcttcagaagagagattatcctggattctctgggtatattcaatttaaatactttccttaactaagctagagagagaagagttgggatgatgatgcactgtgagaaggactcaa

SEQ ID NO: 402673 - DNA, 2101 bp, Homo sapiens
caggagccggggacggtgcgccagtgccccctccgcgagccccaaccagtagacggttccctgtctcccgcgccccaatttcgattttcaaacgcaactcctacaggattctgagaccccgtcccatctcccatatcccatttccagctgcaaattactgcagaatctgaacccaggaaagaaacccatttgccgaccccctcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaacctcgccaacttcgcttatgaccccagcaactacgagtatctgcggcagctgcaggtcctggatttatttctcgattcgctgtcggaggagaatgagaccctggtggagtttgctattggaggcctgtgcaacctgtgcccagacagggccaacaaggagcacatcctgcacgcaggaggtgtcccactcatcatcaactgcctatccagccccaatgaggagacggtgctgtctgccatcaccacgctcatgcacctgagcccgccgggccgcagctttctcccagagctgaccgccacgcccgtggtgcagtgcatgcttcgcttctccctctcggccagcgccaggctccggaacctggcacagatcttcctggaggacttctgctccccccgccaggtggccgaggcccgcagccggcaggcgcactctgccctgggtatcccactgccgaggagcgtggccccacggcagcgctgatccatggagactgcgagaccgtggcacccctactgctggggaccacagtcctgatgtggacgcagggaacggggagcacatactgccccattggtgccttttcagccatctgaaaggcgggttctttcagcaggacaggcatttacactgatgaaacgccactgggagtgaggaagccagactccagagacacggagaagatcaaactggagctgcgttcataggctggcactctcaatcctacatcaggtgccaccaccaccagactcaggccctggtgtaagaagcggccaagtgcctggacccagaggctttgcaggacagtgttctcaggagctgggcctgaggcttaggagagctgccttcgctgcaggaaatcagggattatcccttaacagaagtgtctggagtagttttcaggtataggaatgagatgcctcgtggtgaaaggatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaagatgaagatgtggtccctgcccttgagtgacagcccagggacttaatgtggccatcgggcatcaagcacaaggccatgcaggtgatgatacgtcggaatagaggcaccagccctggtaactgcatcttctccccttgccaccccatggccccggctgaaagcttcggccctcctctgctgtcactcaatgatggggagccctaccccagaagtgtatcccacgagggcatcagggacgcagtgagtgttgctcaagggagtcaggaagagacggcaacgtaaaggatgtggctccatgtccatggtgccccctggtcaacataaggagcgtgggatccgatggaaaggtggagctcagggaaaatgggggtccttgcctctcgtgtaccccctcaaggctgaccccttagatggcccaggaatggcaggtgctacaaaaatggtacccacgtgggcatggaaatggggcagattaggggaccactggactcagaggggagggaagggctcatcagcacccgctcagggagcctgtccctttatgttcccaaataaagggtcctagaagactagaaa

SEQ ID NO: 402674 - DNA, 652 bp, Homo sapiens
caggagccggggacggtgcgccagtgccccctccgcgagccccaaccagtagacggttccctgtctcccgcgccccaatttcgattttcaaacgcaactcctacaggattctgagaccccgtcccatctcccatatcccatttccagctgcaaattactgcagaatctgaacccaggaaagaaacccatttgccgaccccctcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaacctcgccaacttcgcttatgaccccagcaactacgagtatctgcggcagctgcaggtcctggatttatttctcgattcgctgtcggaggagaatgagaccctggtggagtttgctattgcaagacccccccgccccaagcacagtagctttctcagcgtcgaatccctccgtgggaccatgttgcaatgaaatttcaacatgcaaatgaaatttctcgaaatttctc

SEQ ID NO: 402675 - DNA, 1676 bp, Homo sapiens
atagctagtacgaggctgggttgacagcaactacgagtatctgcggcagctgcaggtcctggatttatttctcgattcgctgtcggaggagaatgagaccctggtggagtttgctattggaggcctgtgcaacctgtgcccagacagggccaacaaggagcacatcctgcacgcaggaggtgtcccactcatcatcaactgcctatccagccccaatgaggagacggtgctgtctgccatcaccacgctcatgcacctgagcccgccgggccgcagctttctcccagagctgaccgccacgcccgtggtgcagtgcatgcttcgcttctccctctcggccagcgccaggctccggaacctggcacagatcttcctggaggacttctgctccccccgccaggtggccgaggcccgcagccggcaggcgcactctgccctgggtatcccactgccgaggagcgtggccccacggcagcgctgatccatggagactgcgagaccgtggcacccctactgctggggaccacagtcctgatgtggacgcagggaacggggagcacatactgccccattggtgccttttcagccatctgaaaggcgggttctttcagcaggacaggcatttacactgatgaaacgccactgggagtgaggaagccagactccagagacacggagaagatcaaactggagctgcgttcataggctggcactctcaatcctacatcaggtgccaccaccaccagactcaggccctggtgtaagaagcggccaagtgcctggacccagaggctttgcaggacagtgttctcaggagctgggcctgaggcttaggagagctgccttcgctgcaggaaatcagggattatcccttaacagaagtgtctggagtagttttcaggtataggaatgagatgcctcgtggtgaaaggatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaagatgaagatgtggtccctgcccttgagtgacagcccagggacttaatgtggccatcgggcatcaagcacaaggccatgcaggtgatgatacgtcggaatagaggcaccagccctggtaactgcatcttctccccttgccaccccatggccccggctgaaagcttcggccctcctctgctgtcactcaatgatggggagccctaccccagaagtgtatcccacgagggcatcagggacgcagtgagtgttgctcaagggagtcaggaagagacggcaacgtaaaggatgtggctccatgtccatggtgccccctggtcaacataaggagcgtgggatccgatggaaaggtggagctcagggaaaatgggggtccttgcctctcgtgtaccccctcaaggctgaccccttagatggcccaggaatggcaggtgctacaaaaatggtacccacgtgggcatggaaatggggcagattaggggaccactggactcagaggggagggaagggctcatcagcacccgctcagggagcctgtccctttatgttcccaaataaagggtcctagaagactagaaa

SEQ ID NO: 402676 - DNA, 1618 bp, Homo sapiens
caggggaggtgggaggaggcccggggctacagcatccagactcttccttgctctcccacaggaggcctgtgcaacctgtgcccagacagggccaacaaggagcacatcctgcacgcaggaggtgtcccactcatcatcaactgcctatccagccccaatgaggagacggtgctgtctgccatcaccacgctcatgcacctgagcccgccgggccgcagctttctcccagagctgaccgccacgcccgtggtgcagtgcatgcttcgcttctccctctcggccagcgccaggctccggaacctggcacagatcttcctggaggacttctgctccccccgccaggtggccgaggcccgcagccggcaggcgcactctgccctgggtatcccactgccgaggagcgtggccccacggcagcgctgatccatggagactgcgagaccgtggcacccctactgctggggaccacagtcctgatgtggacgcagggaacggggagcacatactgccccattggtgccttttcagccatctgaaaggcgggttctttcagcaggacaggcatttacactgatgaaacgccactgggagtgaggaagccagactccagagacacggagaagatcaaactggagctgcgttcataggctggcactctcaatcctacatcaggtgccaccaccaccagactcaggccctggtgtaagaagcggccaagtgcctggacccagaggctttgcaggacagtgttctcaggagctgggcctgaggcttaggagagctgccttcgctgcaggaaatcagggattatcccttaacagaagtgtctggagtagttttcaggtataggaatgagatgcctcgtggtgaaaggatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaagatgaagatgtggtccctgcccttgagtgacagcccagggacttaatgtggccatcgggcatcaagcacaaggccatgcaggtgatgatacgtcggaatagaggcaccagccctggtaactgcatcttctccccttgccaccccatggccccggctgaaagcttcggccctcctctgctgtcactcaatgatggggagccctaccccagaagtgtatcccacgagggcatcagggacgcagtgagtgttgctcaagggagtcaggaagagacggcaacgtaaaggatgtggctccatgtccatggtgccccctggtcaacataaggagcgtgggatccgatggaaaggtggagctcagggaaaatgggggtccttgcctctcgtgtaccccctcaaggctgaccccttagatggcccaggaatggcaggtgctacaaaaatggtacccacgtgggcatggaaatggggcagattaggggaccactggactcagaggggagggaagggctcatcagcacccgctcagggagcctgtccctttatgttcccaaataaagggtcctagaagactagaaa

SEQ ID NO: 402677 - DNA, 2133 bp, Homo sapiens
caggagccggggacggtgcgccagtgccccctccgcgagccccaaccagtagacggttccctgtctcccgcgccccaatttcgattttcaaacgcaactcctacaggattctgagaccccgtcccatctcccatatcccatttccagctgcaaattactgcagaatctgaacccaggaaagaaacccatttgccgaccccctcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaacctcgccaacttcgcttatgaccccagcaactacgagtatctgcggcagctgcaggtcctggatttatttctcgattcgctgtcggaggagaatgagaccctggtggagtttgctattggaggcctgtgcaacctgtgcccagacagggccaacaaggagcacatcctgcacgcaggaggtgtcccactcatcatcaactgcctatccagccccaatgaggagacggtgctgtctgccatcaccacgctcatgcacctgagcccgccgggccgcagctttctcccagagctgaccgccacgcccgtggtgcagtgcatgcttcgcttctccctctcggccagcgccaggctccggaacctggcacagatcttcctggaggacttctgctccccccgccaggtggccgaggcccgcagccggcaggcgcactctgccctgggtatcccactgccgaggagcgtggccccacggcagcgctgatccatggagactgcgagaccgtggcacccctactgctggggaccacagtcctgatgtggacgcagggaacggggagcacatactgccccattggtgccttttcagccatctgaaaggcgggttctttcagcaggacaggcatttacactgatgaaacgccactgggagtgaggaagccagactccagagacacggagaagatcaaactggagctgcgttcataggctggcactctcaatcctacatcaggtgccaccaccaccagactcaggccctggtgtaagaagcggccaagtgcctggacccagaggctttgcaggacagtgttctcaggagctgggcctgaggcttaggagagctgccttcgctgcaggaaatcagggattatcccttaacagaagtgtctggagtagttttcaggtataggaatgagatgcctcgtggtgaaaggatctcaccctgggaagatgtggtgccccctccagggctctggaggatggatgcctcccccaggggctctccaagctgggcatttgggcctggtggatgccaacctggataacctgtggcccagcattgactgtccacccagccttgctgttaggcaccatgactccaagatgaagatgtggtccctgcccttgagtgacagcccagggacttaatgtggccatcgggcatcaagcacaaggccatgcaggtgatgatacgtcggaatagaggcaccagccctggtaactgcatcttctccccttgccaccccatggccccggctgaaagcttcggccctcctctgctgtcactcaatgatggggagccctaccccagaagtgtatcccacgagggcatcagggacgcagtgagtgttgctcaagggagtcaggaagagacggcaacgtaaaggatgtggctccatgtccatggtgccccctggtcaacataaggagcgtgggatccgatggaaaggtggagctcagggaaaatgggggtccttgcctctcgtgtaccccctcaaggctgaccccttagatggcccaggaatggcaggtgctacaaaaatggtacccacgtgggcatggaaatggggcagattaggggaccactggactcagaggggagggaagggctcatcagcacccgctcagggagcctgtccctttatgttcccaaataaagggtcctagaagactagaaagccaaggtcttttattaaaggtcccgactggt

SEQ ID NO: 402678 - DNA, 1212 bp, Homo sapiens
caggagccggggacggtgcgccagtgccccctccgcgagccccaaccagtagacggttccctgtctcccgcgccccaatttcgattttcaaacgcaactcctacaggattctgagaccccgtcccatctcccatatcccatttccagctgcaaattactgcagaatctgaacccaggaaagaaacccatttgccgaccccctcttccctctccagacaggtggagagcgggtgagggtctcgctcggctttccccctgcacctttcccaccctcccgcccgtccctgggggtcctccgtcaccgcggccatggcccagaagccgaaggtggacccccacgtcgggcggctgggatacctgcaggcgctggtcacggaattccaggagacccaaagccaagacgccaaggagcaagtcctcgccaacctcgccaacttcgcttatgaccccagcaactacgagtatctgcggcagctgcaggtcctggatttatttctcgattcgctgtcggaggagaatgagaccctggtggagtttgctattgctgctgcagtctgaacggtgacggtggcccctgcagaagcatgtggctaaatctccaccagggggcgatagagctcctccaaatcaagctgctgcccctggagaaaaattggcggaagtcacagagcagtccccaccaaaagtgtttaccaagtggagtctttcctgctggcgtttcctcagggtcaggaagcaactttcccaggacaggggcaccctgaggtccgggtccactgagctatgggggcggcgtgggcctgggctgggttcttgccatcctgggcagcttcccggcgtgggtgactgagcccgggtcctggagtccgcggtcccagcgtctccacttctcagctgattcctagaagctgagtcccgtcccttctccgagcgtggtttcctctcccgccttgcctgcgtcgcaagcagttgtgggagcagaagtgtgtctgtgcatctgtgtctctgtgcaggtattttagaattgttaggatcattatcaccagctttacttttcccaaccatttttttcctcctttttttctcttccttcttctgccacagcaagacccccccgccccaagcacagtagctttctcagcgtcgaatccctccgtgggaccatgttgcaatgaaatttcaacatgcaaatgaaatttctcgaaatttctc

SEQ ID NO: 402679 - DNA, 4364 bp, Homo sapiens
  misc_feature (263)..(263): n is a, c, g, or t
  misc_feature (2896)..(2896): n is a, c, g, or t
  misc_feature (2940)..(2940): n is a, c, g, or t
  misc_feature (2956)..(2956): n is a, c, g, or t
  misc_feature (2963)..(2963): n is a, c, g, or t
  misc_feature (3001)..(3001): n is a, c, g, or t
  misc_feature (3005)..(3005): n is a, c, g, or t
  misc_feature (3015)..(3015): n is a, c, g, or t
  misc_feature (3060)..(3060): n is a, c, g, or t
  misc_feature (3066)..(3066): n is a, c, g, or t
  misc_feature (3086)..(3086): n is a, c, g, or t
  misc_feature (3111)..(3111): n is a, c, g, or t
  misc_feature (3124)..(3124): n is a, c, g, or t
  misc_feature (3129)..(3129): n is a, c, g, or t
  misc_feature (3138)..(3138): n is a, c, g, or t
  misc_feature (3347)..(3347): n is a, c, g, or t
  misc_feature (3501)..(3501): n is a, c, g, or t
  misc_feature (4061)..(4061): n is a, c, g, or t
  misc_feature (4134)..(4134): n is a, c, g, or t
  misc_feature (4154)..(4154): n is a, c, g, or t
  misc_feature (4207)..(4207): n is a, c, g, or t
  misc_feature (4236)..(4236): n is a, c, g, or t
  misc_feature (4244)..(4244): n is a, c, g, or t
  misc_feature (4271)..(4271): n is a, c, g, or t
  misc_feature (4285)..(4285): n is a, c, g, or t
  misc_feature (4352)..(4352): n is a, c, g, or t
ctgatgctgataaattgaagaagaaaacagctgaggacagaacgcaggcatttcacctgcggcagaacctgagcgccctggataagatgcatgaggagcaagagcttttcactgagaagatgagaggggagctgcgcgcctgtcggcagaggcgggacctgatcgacaagcagcaggaggctgtggcagccgagatcgccacagaggaagaggcgggcaacatggccgctgtgggccgcctccaggccgtgtccagacgcctntttgcagagctggagaacgagagagacctgcagtcgaggactgaggccgtgctgaaggagagcgagaacaccatgtggcacatcgagatccaggaggggcgactcgaggccttccggacagctgaccgtgaggaggtggaggccacggggcggcggctccaggtgcgcgcagccgagcagctctgcagagagcaggaggccctggggaaggtggagcggaaccgactgctgaggatcaggaagtccctgaacacccagaaggagctcgggctcaggcaccagaagctgctggaggacgcccggaagaaccacaaggttgccgtgcggttcctgaaggcctccctgggaagaatccgagagcaagagaagaaggaggagatggagtgccacgagtacatgaggcgacgcatggatgcggtggtggcgctgaagggcagcatctccgcgaaccgggacacactgcggaagttccaagcatgggaccgtgccaaggcagagctggcggagcagagggtccaggctgagaagaaggcgattctggcccagggcagggatgcattcaggcaccttgtccaccagcgccggcgccaggagctggaggcccagaagagggcctttgaggaggagcagaagctcagaaagcaggagatcatcagtcggattctgaaagaggaggctgaggaggaaaagaggaagaaacagcatccccccaccagtgccaggcaccggctgaccctgagggacaagacctggaactacatttctgacttttgcaagaagaccacagtcccaaccaacacgtacacactggactacgaggctgctgcaggccccgggccctctcggttgctggaagtcgtttccagtgagcttatccagggggaccccggggccagctcagaggaggaaacgttagctgagcccgagatctctgggctttggaatgaagactacaagccataccaggtgcccaaggaggacgtggaccgaaagcccgtgggcgggacaaagatggacaaggacatcctggagcgcacggtggagcggctgcggagcagggtggtccacaagcaggtggtgtgggggcgtgagttccaaggacgccccttcaacagcaaaccggagctcctccacttccaggactttgatattggcaaagtgtacaagaaaaagatcacgttggtaaacaccacctacacgatcaactactgcaagctggtgggcgtggaggagcacctccgggacttcatccacgttgactttgacccccctggccccctgtcagccggaatgtcctgtgaagtgcttgtcaccttcaagccgatgataaacaaggatctagaaggaaatatctcatttttggctcagacgggcgagttttcagttccactgaaatgttcaacaaagaaatgttcgctgtccctcgacaaggagctcattgacttcggcagctacgtggtaggagagaccacgtctcggaccatcacgctgaccaacgttgggggcttgggcacgactttcaagttcctgccagcttcagagccctgtgagatggacgactcccagtctgccctgaaattaagcagtctcctgacctacgaagataaaagcttgtatgacaaagccgccaccagcttctctgagcagcagctagagggcacggagtcctcccaggcggacatgcagagccggaaggagctggagaagctggacaaggagcaggaggaggagcagcccgcaggtgagccaggctgccaggccaagccagggtgggcgggcggtgagggcctcagggcagcattccagggggctgaggggcccaggggagggctggaaagtagagaattttcccaggccttcgatgttaagtgacggttaagcaagaaaatattcttatgtgccactaagtgttgtttttggagtggacgaaaatgtacattcacgttgacgctaaccgaagacttgaaggcacctccagcattggcccagcaggcccagcacgggcggagccgcacagggcggggaagaggctctgcggtgccccctggaggggccgggctgcggggggcttctgtctagctctgcagctgtggctgttgttagacgcgcaccagcggggagaggtgccgagaaacgggcgggccctgccctccccatgcctcctgccctgcagcccgccgccatcgggaatcgcttgcgtctcctccttgcttctcttgatcgttttcccacatacgcatcgagatccagaaacctccgtcctcctcctgtctgtcttcgcgtggtgcgcgttccgcacgccctgcagctcagcgcggagctgggccggttctccacagcctgtgtgagcctcacttccggtgtgagccgcacttccggtgtgagccgcacttcctgtcctcaccactgcgtggcgtttcctttcctgagagagcctcgggttctagatccgtccttctgccagtgcgcacttgggagcgttcgtggtacacactgttgcgaaggccgttctgcactgccccttggcctgtgtgtgagttcccacagggcacctggctggggctcatgcctgcatcacagggcatagccagcctcactggcatcagctaataccaaagtgagttctttttctnttgagacagggtctctgtcgcctaggctggagtgcagtggtgcngtcacagctcactgcngcctcgncctcccgggctcaagcaatcctcctgcctcagctcctnagtngctggaactncaggcacgcaccaccgcacctggctagtttttgtatttttttgtngacacngggtttcgccatgtttcccnggctggtgtggaactcctgaactcnggctgtctgcccncctcngcctcccanggtgctggattacaggcatgagccacctcgcctagcccaccgagttctttttcaaagtggttgtgcaagtttacactcccaccaacagtgtacaagactgtgctgtccagcgtggctgtcactgccacatctggctatttaaacttaaattgatccaaattaaataatagtgaaaattcaggtcctcctccacaagggccacatttcanatgctccatagcgacctgtgggcaacggctgccctactggacagcccagaagcccagctctgcctggtcacagagggtcctacggggccacactgggcttgagggccttgcttcacatccgcaggagcacgaggtcacacggcccggggctgcntgtctggggggcctgcaccacggtctgctgttgagatgttgctttttggtttcccagatcaccagtgagattgcgtgtctttccctgggcccatttacaagttgtatcttctttggtgtgacatctctgtttaaggctatcccttgttcttctgtgggattgtctgtcttcttctcattcattcataggagctcttcatgcacccagattccagccctcctccctgaggaatgttgcaggtgctgcctccgagtctgtggctgggccttcctctccctttatgacgtcttttctcaaatcaaagttcttcagtccagtctttgcatatttaccagtcatttctattggaatttgttttttatgatttttaggcaatttttttctcctccagggtcataaagacataggacatcgcttttgtgttgaggtgtatgatccacctcaaattcactcctgcttgtggtggaagtcagggctgaggctcatttcccctggtgcgtgtttgtgtattccacggcacaagtggactctgctatcccattcgatccattcgttgtccntgtcaaaaatcaattgaccatccaggcacagtggctcatgcctgtaatcccagaactttgggaggccgaggcnggaggatcacttgaggtcangagtttgagaccagcctggccaacatggtgaaaccccatttctactaaaaatncaaaaaattagccaggcgtggtggcgggngcctgtantcccagctacttgggtggctgaggcangagaattgcttgancccgggaggcggaggttgcagtgagctgagatcgcgccattgcactccagcctggcctataagagtnaaatactgtctc

SEQ ID NO: 402680 - DNA, 2921 bp, Homo sapiens
  misc_feature (1453)..(1453): n is a, c, g, or t
  misc_feature (1497)..(1497): n is a, c, g, or t
  misc_feature (1513)..(1513): n is a, c, g, or t
  misc_feature (1520)..(1520): n is a, c, g, or t
  misc_feature (1558)..(1558): n is a, c, g, or t
  misc_feature (1562)..(1562): n is a, c, g, or t
  misc_feature (1572)..(1572): n is a, c, g, or t
  misc_feature (1617)..(1617): n is a, c, g, or t
  misc_feature (1623)..(1623): n is a, c, g, or t
  misc_feature (1643)..(1643): n is a, c, g, or t
  misc_feature (1668)..(1668): n is a, c, g, or t
  misc_feature (1681)..(1681): n is a, c, g, or t
  misc_feature (1686)..(1686): n is a, c, g, or t
  misc_feature (1695)..(1695): n is a, c, g, or t
  misc_feature (1904)..(1904): n is a, c, g, or t
  misc_feature (2058)..(2058): n is a, c, g, or t
  misc_feature (2618)..(2618): n is a, c, g, or t
  misc_feature (2691)..(2691): n is a, c, g, or t
  misc_feature (2711)..(2711): n is a, c, g, or t
  misc_feature (2764)..(2764): n is a, c, g, or t
  misc_feature (2793)..(2793): n is a, c, g, or t
  misc_feature (2801)..(2801): n is a, c, g, or t
  misc_feature (2828)..(2828): n is a, c, g, or t
  misc_feature (2842)..(2842): n is a, c, g, or t
  misc_feature (2909)..(2909): n is a, c, g, or t
tgactgtgctctgggtggtgaggcgagcgtctgccctccgcagcactaacccccgtgtgctatgggtcacgccctgcagctttgacccccctggccccctgtcagccggaatgtcctgtgaagtgcttgtcaccttcaagccgatgataaacaaggatctagaaggaaatatctcatttttggctcagacgggcgagttttcagttccactgaaatgttcaacaaagaaatgttcgctgtccctcgacaaggagctcattgacttcggcagctacgtggtaggagagaccacgtctcggaccatcacgctgaccaacgttgggggcttgggcacgactttcaagttcctgccagcttcagagccctgtgagatggacgactcccagtctgccctgaaattaagcagtctcctgacctacgaagataaaagcttgtatgacaaagccgccaccagcttctctgagcagcagctagagggcacggagtcctcccaggcggacatgcagagccggaaggagctggagaagctggacaaggagcaggaggaggagcagcccgcaggtgagccaggctgccaggccaagccagggtgggcgggcggtgagggcctcagggcagcattccagggggctgaggggcccaggggagggctggaaagtagagaattttcccaggccttcgatgttaagtgacggttaagcaagaaaatattcttatgtgccactaagtgttgtttttggagtggacgaaaatgtacattcacgttgacgctaaccgaagacttgaaggcacctccagcattggcccagcaggcccagcacgggcggagccgcacagggcggggaagaggctctgcggtgccccctggaggggccgggctgcggggggcttctgtctagctctgcagctgtggctgttgttagacgcgcaccagcggggagaggtgccgagaaacgggcgggccctgccctccccatgcctcctgccctgcagcccgccgccatcgggaatcgcttgcgtctcctccttgcttctcttgatcgttttcccacatacgcatcgagatccagaaacctccgtcctcctcctgtctgtcttcgcgtggtgcgcgttccgcacgccctgcagctcagcgcggagctgggccggttctccacagcctgtgtgagcctcacttccggtgtgagccgcacttccggtgtgagccgcacttcctgtcctcaccactgcgtggcgtttcctttcctgagagagcctcgggttctagatccgtccttctgccagtgcgcacttgggagcgttcgtggtacacactgttgcgaaggccgttctgcactgccccttggcctgtgtgtgagttcccacagggcacctggctggggctcatgcctgcatcacagggcatagccagcctcactggcatcagctaataccaaagtgagttctttttctnttgagacagggtctctgtcgcctaggctggagtgcagtggtgcngtcacagctcactgcngcctcgncctcccgggctcaagcaatcctcctgcctcagctcctnagtngctggaactncaggcacgcaccaccgcacctggctagtttttgtatttttttgtngacacngggtttcgccatgtttcccnggctggtgtggaactcctgaactcnggctgtctgcccncctcngcctcccanggtgctggattacaggcatgagccacctcgcctagcccaccgagttctttttcaaagtggttgtgcaagtttacactcccaccaacagtgtacaagactgtgctgtccagcgtggctgtcactgccacatctggctatttaaacttaaattgatccaaattaaataatagtgaaaattcaggtcctcctccacaagggccacatttcanatgctccatagcgacctgtgggcaacggctgccctactggacagcccagaagcccagctctgcctggtcacagagggtcctacggggccacactgggcttgagggccttgcttcacatccgcaggagcacgaggtcacacggcccggggctgcntgtctggggggcctgcaccacggtctgctgttgagatgttgctttttggtttcccagatcaccagtgagattgcgtgtctttccctgggcccatttacaagttgtatcttctttggtgtgacatctctgtttaaggctatcccttgttcttctgtgggattgtctgtcttcttctcattcattcataggagctcttcatgcacccagattccagccctcctccctgaggaatgttgcaggtgctgcctccgagtctgtggctgggccttcctctccctttatgacgtcttttctcaaatcaaagttcttcagtccagtctttgcatatttaccagtcatttctattggaatttgttttttatgatttttaggcaatttttttctcctccagggtcataaagacataggacatcgcttttgtgttgaggtgtatgatccacctcaaattcactcctgcttgtggtggaagtcagggctgaggctcatttcccctggtgcgtgtttgtgtattccacggcacaagtggactctgctatcccattcgatccattcgttgtccntgtcaaaaatcaattgaccatccaggcacagtggctcatgcctgtaatcccagaactttgggaggccgaggcnggaggatcacttgaggtcangagtttgagaccagcctggccaacatggtgaaaccccatttctactaaaaatncaaaaaattagccaggcgtggtggcgggngcctgtantcccagctacttgggtggctgaggcangagaattgcttgancccgggaggcggaggttgcagtgagctgagatcgcgccattgcactccagcctggcctataagagtnaaatactgtctc

SEQ ID NO: 402681 - DNA, 496 bp, Homo sapiens
taatctgataaaaggtagctgtaatgacatttagcgcctcagtcatatttaatgataaaatggaaagctttccttttcagatcaggaacaaaacaagggtgcctcctgttaactattttcctcaacagtgctttagaagttctggccagtgtactagtataagaaaaagaaataaaatataaaaattagagggggggaaacctgtccctttatttgcagatgttatgaatatgtatttagaacatgaaagagaacctatggataagtcattagtattaataagagagtagggttcctgagtataaaatctgtacataaaaatcagttcttcctgccagcagaggtattattaaaaaatcgatcctctctctttaaataagcaataagtgctcagaaaatgaaatattataacgtctataatagtatcagaaaatatcaagtatcttataataaacccaacaaaagaagtataagacttttgtgaagaaaagaaaaa

SEQ ID NO: 402682 - DNA, 1007 bp, Homo sapiens
  misc_feature (181)..(181): n is a, c, g, or t
  misc_feature (192)..(193): n is a, c, g, or t
  misc_feature (197)..(197): n is a, c, g, or t
  misc_feature (202)..(204): n is a, c, g, or t
ctcacacccaccgcaatacccgagacttttattaccccgtcaattccctcccctttgtaatcaatcaatagggaggttccttcgcgccacggtccacataccccaacccccgctcccggctccaattttcaccatacaccccccaccgcagaggcgacgcccaaaatgctctccaccttanccgccccatcnngttntaatnnntcccggaagtagagacactttacatccggcacaggaagccttctgatggagcacacctggcccatgaaaagacaagggaaagaaacggggccaaaggtcacagtcctctcatcccatcatcctccttaaaatcatcctaatttcatgggccctgaagccagggctgtttctttacacctagaggccttggcgccgggcctcaattccgccctgttccttaccgtctaagacatgttgggaaaatccctagagccaggatcttcattcctgctaagccagacagccggaagacacacccaaattctgtccctcttacttcagggaacatgtccactttcggcagcgttacaattttggcaccaaatgtgctaactgcaattccaccatacaatgcgtaactggaaatggaggcaacatctccgatcctgaacgatcgatgcgagaatccaggatatgcacggcttattttggccttttcccactgaaacaagggccagtattaaaaatggcacgctatcctctgtttcactccctgcttttaaacgtctccgatgtttctccctgagacagggcctcacttccgtcagccgggcttttctacggtataattttccttgtttgcttttgtccaaattagaactttttatttcatctctaggaaacgttgatccattatcacatacgtatggaaatattatcaaacatgctgtgagatacgttgtttttattttcatcaattccttaataaacacggatgcggccaggttttttttttcccactattaaataatatatatatggca

SEQ ID NO: 402683 - DNA, 980 bp, Homo sapiens
  misc_feature (181)..(181): n is a, c, g, or t
  misc_feature (192)..(193): n is a, c, g, or t
  misc_feature (197)..(197): n is a, c, g, or t
  misc_feature (202)..(204): n is a, c, g, or t
ctcacacccaccgcaatacccgagacttttattaccccgtcaattccctcccctttgtaatcaatcaatagggaggttccttcgcgccacggtccacataccccaacccccgctcccggctccaattttcaccatacaccccccaccgcagaggcgacgcccaaaatgctctccaccttanccgccccatcnngttntaatnnntcccggaagtagagacactttacatccggcacaggaagccttctgatggagcacacctggcccatgaaaagacaagggaaagaaacggggccaaaggtcacagtcctctcatcccatcatcctccttaaaatcatcctaatttcatgggccctgaagccagggctgtttctttacacctagaggccttggcgccgggcctcaattccgccctgttccttaccgtctaagacatgttgggaaaatccctagagccaggatcttcattcctgctaagccagacagccggaagacacacccaaattctgtccctcttacttcagggaacatgtccactttcggcagcgttacaattttggcaccaaatgtgctaactgcaattccaccatacaatgcgtaactggaaatggaggcaacatctccgatcctgaacgatcgatgcgagaatccaggatatgcacggcttattttggccttttcccactgaaacaagggccagtattaaaaatggcacgctatcctctgtttcactccctgcttttaaacgtctccgatgtttctccctgagacagggcctcacttccgtcagccgggcttttctacggtataattttccttgtttgcttttgtccaaattagaactttttatttcatctctaggaaacgttgatccattatcacatacgtatggaaatattatcaaacatgctgtgagatacgttgtttttattttcatcaattccttaataaacaaaagggtatagctgggataccttct

SEQ ID NO: 402684 - DNA, 791 bp, Homo sapiens
  misc_feature (11)..(11): n is a, c, g, or t
  misc_feature (72)..(72): n is a, c, g, or t
  misc_feature (175)..(175): n is a, c, g, or t
  misc_feature (318)..(318): n is a, c, g, or t
  misc_feature (488)..(488): n is a, c, g, or t
ggtggaggttncagtgagctgagatcgcaccactgcactcaagcctgggcgacagagggagattccgtctcnaaaaaaaaaaaaaaagagacaacacagagacagaggagaagcccacgtgaggctggagtgatgtggccacaaaccaaggaacacctggagccaccaggagctngaaggctggctggaagaggcaggaaggtacttccctagagcctctggagggagtggagccctgcccacaccttgattgcagacttctggcctccggagctgggagagaatatatttctgttgttttaagcaaccccagatcanggtacttgctgtggtagccccagaaagcaaatacgagggagactgagagcctcagtctttgagatcctgtcatcactgcctctcgagtcgccatgggcatgtggcctcaggccgtcagcatctcagggtgttggctctgctcaaagccatccgtcctcgtccacattgcnccttgtccaggccttcttcgagttggtcacctgagcctattattgacggtttggctgtcctccccgttgcaagcatggggatggtgcgatgctgccatttgtcaaacaagagccccggaaagccagaggtacaaccaaagacagaaaaataagaaccatgagcagtcgcggtgcctctattattttcccaggacgattgctcttttcctccaatgggcctggggaagaagcaattctcacagatcctcctcaacatgaagggtgtcagggtccctgcagatttggctggagctccagacctcc

SEQ ID NO: 402685 - DNA, 474 bp, Homo sapiens
tccctcccgccaaaccgccgagtgggcccaggcgtccgacccgcccccggcgccatagcaacgcagaaggcttcgactcccagggggccttgcggctactcagccaggaggggcgcgaagatctaacagaagcgggagagggacgcacgcctgcccgtcttccgcagacccacaccctcgggagcctcagttttcccatttgtacaacgacaagactaacccagagaagcgggttcactgttgcgataacgcgtcctaccctttgtttgacctctcccactttccaacacacccctccttcgagaatcagcccggcctcctgtccggcctaatcagaatcattcttttgcgtaatcccgcctcctccgataagcctcgccccgttcccgcccctaccattccgccctgcctcctttgtgatcagccccgccctccactggtctcgccaatgaatcgcgtcccgtttctccaatc

SEQ ID NO: 402686 - DNA, 314 bp, Homo sapiens
ccccacccacccctcctaatggctctgaatctcccccatgcctctccgcttcttctctctccacgccctatgtacccacgcccttctccactcctgttttaggctttagttccccgaagtcttctggttccctctctggcccctcccgggctggcgcctgcaaacccaccccatcccccattcccaacgcccccacccctcccactcctgggcccctgccttctgcggatccctgaactcgaggcctggcgcggattgcagatactcagtaaatattcgctgaaagagcaaataaaatgaaaaatcgtgttgaa

SEQ ID NO: 402687 - DNA, 439 bp, Homo sapiens
gcactcatgaaggcccgcgtgagtgctttcccccgcacccagcactgactcagaaccaccaccttctgctttgctgtcggacttcaattcctacctgttttctgagtgcagtcctagcaggtgaagcaaggtgatgtccttgccaagaagttgcattcctgtctgctttgcatctgctactttgctgcagtttggattcagagcagaatggaccccactctgtcgaggtgacctgaagggaaacgccaggctctgtagcagcagaggcaaggttccaaggtgtaaaggtcatgctgctagcacattattaaaaatcagtctgggtgcaatggctcacagctataatcccagtactttgggaggtctaggtaggagggttgcttgaagccaagcatttgagaccagcctaggcgaaaaagagagactcagtctctacaaa

SEQ ID NO: 402688 - DNA, 150 bp, Homo sapiens
actgactatacattgtaaataaccagtccatggatgtgtccctgcattggaacccaagattaagatttggatatggatgatgtatgcttatataagtctttttacttgtttgtctacactgtcttaataaatcagtcttttttttctaca

SEQ ID NO: 402689 - DNA, 396 bp, Homo sapiens
gagatggagtctcgctctgtcacccaggctggagtgcagtggcccaatctcggctcactgcaagctccgcctcccgggttcatgccattctcctgcctcagcctcctgagtgtttggttctcaagccagagactagctgcccttggaacttgatcccaccatggaagggctcaaggaaagctatagattttctcgtctaacctcactgtgttacctatgaggaaactgaggcccagagagtgaaatcacttacccaaagccacacagctagaggcagagagtgggatctagagccttggtctgtgccttctaggccagagcttctattgtcagggacagaagaccaagcttggatctcatttcatgaccctgaccctgcccttccagccagatctc

SEQ ID NO: 402690 - DNA, 839 bp, Homo sapiens
aagcagtccgtcttgacgttctgtgcaattacttctctagcaagaggggaagggcacacaagcagtaacctatgatcaccagaaactgcctatagcctgtcatcgtgagatttattccttcctgtgtgattggagattgagaatcagtccagccagcatcgtaaaacattaaaagtagattaaggattatccctcaaagcaaaggaactttgaaccttagttttctttctaagctgttttggttgattttatgagacacataatcaacgtacattaaataatctgggctggctcatgcctgtaatccatgcagttcgggaggtctaggcaggaggggattgctcgagaccaggaattcaaaagcagcctgggcaacatagcaagacctcatctctacaaaaacaaacaaaaaaaatagctgggtgtggtggtgcatgccggtagtttcagctacttgggagcctgaggcaggaggatcacttgcacccaggagctcaaggctgtagtgagctgattgcaccactgcactccagcctgggagaccaaaaaaaaaaaaaaaaaaaaaaaaaaaacatttggagggcggcactgggccctcggaagaggtttaagaacaatgggggggagccgggggccccaaggggaacggggacacggggcaaaagggtgaaccacaagggaaaaccccggggcagaacccaacgaggaggggatatctacgcaaaaaaaaaagcgccgaggcggaaaccaggagagttatgagaaaaagtcacaagagaagtcagaaggacaaacagggcatataacaaggagtccaagagacccgaatcaaagtgccg

SEQ ID NO: 402691 - DNA, 369 bp, Homo sapiens
tcgaagattccaagacctgcacatgaaggatacagctggccccacccagatcaatgaactggctcatctgatctcgtgcccctcctccccaacccagtaactgactgcgcattgcattctggtggaacaactgatgccacccagacttgtgacccccacccaggaactgacagaggcacagagacagttttgataaccctgtggtttcatccctgaccaaaccaatcagtatttcccattccctagctccctgcctgccaaactatccttaaaaccctagcctccgcattctctgggaggcagatttgagaattgtctcatcttctcgcttggctggccttgcaattaaacatgttctttgctgcaaaa

SEQ ID NO: 402692 - DNA, 367 bp, Homo sapiens
tccatcttgcttctgaccttcaagctgtccttgtacattcttgggtggatgccaaactaactttgggaaggaattcagttcatgatttgactctgaaacaaaattggcattgcattctggtggaacaactgatgccacccagacttgtgacccccacccaggaactgacagaggcacagagacagttttgataaccctgtggtttcatccctgaccaaaccaatcagtatttcccattccctagctccctgcctgccaaactatccttaaaaccctagcctccgcattctctgggaggcagatttgagaattgtctcatcttctcgcttggctggccttgcaattaaacatgttctttgctgcaaaa

SEQ ID NO: 402693 - DNA, 440 bp, Homo sapiens
tgtacctcatttattatttgtgaaataattacaacttctgaatgccattatgagttaagagagaaggggtctagcttttggactttaggtctccccatctaccacctgcctgctacccatcattctggctccccagtcccccagaatctgcctgacagtgggacacgaatgcccacaggcataacaatgaagctgctaggaggccatacccaaagctactatgatgataagatggcaagacatggagtggcaaaggcaccagaagtttaactctgggactatctgtccatcacctttctttcttgcacagcatgcaggttgcatgggcttaaactgtagtggtcaataaagccacacagatcagggtgagcaaatgaaaggcaaatctaactcaggtagaaaaaagagcatttatttccttgactggtaccctatcaaag

SEQ ID NO: 402694 - DNA, 984 bp, Homo sapiens
tagtagagatggggtttcaccgtgttagccaggttggtcttgatctcctgaccttgtgatctgcccacttcggcctcccaaagtgctgggattataggcatgagccaccgcgtctggcccaccccagctaaatttttaaccaaatttgttttattcattaagagatcgttcatgcttttcttctacaatgctgaacctctctctttaataagatttgtagtactaatgatttaaaacaaacaaaagcaaatgtgttctgaaattctgaaagatgagttcaggtttcttgtgtctctgatgaagtaaactcagataaatacagagaagtgcaaattatcctttatcacatgtcttggaagagccaattccatgaagttaatcagtaattattttggcaggctgcacttgtgaggaacttgcaccctccctgttgtttgacgaggggtgtcttgtcagaaagtaaatttataacattgttcatttttttctttaagtgattgtaacaaatatttggtggtaaatttaactactgaaattaggaatactttgtgaaactaagagggtagcattcagcagctttagaatcttttctttctttttttaaagacagtctcgctctgtcaccgaggctgaagtacaatggcaggatcatggctcactgcaacctccacctcctgagttcaagcagttctcatgcctcagcttcccgagtagctgggactacaattgtgccaccaccatgcctggctaatttttgtattttctgtagagacgggattttgagaccagcctaggcaacatggcgaaaccatgtctctactaaaaatacaaaaaattagccgggcgtggtggtgcattcgtgtggtcccagctccttggggagctgaggtgggaggatcgcttgaggccaggaagtcaaggctgcagtgagcccagatcatgccacagcactccagcctggcgacagagtgagatcctgtctga

SEQ ID NO: 402695 - DNA, 390 bp, Homo sapiens
ctagcacttggagctggctgacagagaaatagactgcttgggtgactgcctgtttccttctccaggacaagactgaatgggaagtctttatgggattctgaaaaatatgatagacctccctcaccccccaccaggaactctgagtcagacagccctgttggcattcgggctcttgtgcctgatgggttttttttttttttatactttaagttctaggtgtgcctgatggttttgaggcctctgactctgttactctgtacctcctcatcattggagccatcactgtaaccctgtgtccctcagggcttgggcggggcttaagtgagtcctgtatgcaaagcagccagagccctacctcttagtatgtgctaaattaagtgttagtctcag

SEQ ID NO: 402696 - DNA, 685 bp, Homo sapiens
ttcaaagcttcaaattattcagtaacatctaagagtgataattgtatctctcaggaggcacatctaatgtttaaaaagaaacgttgacttctaagacaatgaaggagctatttacacttgctgcagaagccaaatcacttatcaatagcctgcctctcctaaatgagttaatagaactattcacagggccaagactattgatgtttagtatatcttgggccttttgagttaatttttccactgccgagttgcaataaaagacagtgaaagactttgtcttttaacagtgaagtaaatagagctataatagaaagtacactggcctagcctcggtgtccaaaaaataggtcaactctcccaaccatattttttatttttctatcataaatcccttaacctctttcaacctcagttttcccatttataaaatgaaacaataaaactggaaattctcttaaagtctagtgtacctctaatactctaagattataatatttacattgttatcaatatgagagttgcaaagaccagttcttcccgccaagagcatggcttttctgggggcgggaagtctaattcctaatggatacactatgacatggcttggaggggcattgaataacttcttccaaaatctccaccagctgtccttggaaatccagaaacagaagagacaatctaaatt

SEQ ID NO: 402697 - DNA, 274 bp, Homo sapiens
ttgctaagggtctaaaatacattggtcacttttgaatagatagcagggttaaggaattaaagaactctgttttctcatgaccttcttttatcccgactttcggaactttcttctttatttaggccactttcagtgctctctctatggaactatttgtccattctacaaacccaaccctttcttgatccctgtagctttaagtaaatcttgaagccaggttatgtcagttctccaattttgcttgtttcattcaatatggagttggctattcctt

SEQ ID NO: 402698 - DNA, 409 bp, Homo sapiens
gaggggaatcgagggtgaaaaggaagaaaatgagaataaataaaaccagaaagagatctcccagaaactaatgaaaaaagtgagctgaagaattttgttaaaatcgatactctggatgtgagatcccataggacacggggccctattgacaaggtaaactcctaaaggagatgaattctgatggtgaatctgtctggtcctgggctttttttttttttttttggttggtaggctattaattactgcctcaatttgagaacttattattagtctattcagggattcgacttcttcctggtttcgtcttgggagggtgtatgtgtccaggaatttatcagtttcttctagattttctagtttatttgtgtagaggtctttatagtacactccaatggtagtttgtatttcc

SEQ ID NO: 402699 - DNA, 485 bp, Homo sapiens
aggtgtttcaatagttaataatgatcaaacgttataaatattgggaaactataatggatgaggtgaaaaagaaaaggccactaagtagaaaattagataaaatagacatatataaaattaagtcatgtgttatgggctaaactgtgtcccccacaaaattcatgttggggtcagtacctcagaatgtgtctgtatttggagacagggcctttatagaaataattaaattaaaatgaggtcactagggtcagctctaatccaacaagatgggcatcctgataggaagagggaatttggatacagagggaagattatataaagacacggggagaggatgaccatctacaagaccaagagagaggcctgtccgtaagaaaccaaccctcaaggagagaggcctttctgtaagaaaccaaccctgccagcacccagcttttggagctctagtctccagaaatgtgaaataaatttcttttgtttaagcc

SEQ ID NO: 402700 - DNA, 826 bp, Homo sapiens
gggcggggccgcgccgtccacaccggccgcagccggttttcgaggcgggcgccgagcggatccgcggcggaggttgagggaccccacacatcccacgagaacacacgacctacagaatgaagatactgaccactcatcaaccaatacagacagggactcatatacagatgggcagagagagttacagcagggcctatgggaagttacgcgacgtgacagaaaggacgtcggaagccagaagggcacatcggacaacatggggggcaccacaccgagacgatggcaccgcgcgggacagtggccacgaccggggggacaccccagggacacgatccaaggaacagaggcggacaccaattccaacccggataccagaggacggcaaagaaaggaagaccgaagcgcacacaagagaacacaaagcgaccgtgcgctaggggcaccggcagggtgcacaggggattggcaacggcatgcggccacattttacgaaaggcaagtggatcacaaccacgaggcacacaacatgaaccttgacacatggagagggggcacacacgaagaaacggccaagagaccatgacaaagaaagcccaaaggaaggcacagttgcaggcccattgaggaggacacgcgagtgagcaacagggaacagtgcggcccaccaggggaatgcacgagagaccaacccgaggggacaaacgataacagagcaaagagcactcggcaacggacacacagaagcgaggagcacggaacaacgtggaggagaaatcggggcaaacaatgggagaacagggtgcgaggcaaggatgcagacactccg

SEQ ID NO: 402701 - DNA, 109 bp, Homo sapiens
aattcaagcttctaacgatgtacggggcatgtttgtttttgaagctcaggtgtctcacgtctgggctgcaccaggcgaagagagaaattaaagatttgaggtttttcca

SEQ ID NO: 402702 - DNA, 4502 bp, Homo sapiens
cgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgatcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcccgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggcggccaccgcgcccacctcccatctgaaggcacagcaccgcagtggtggcctgtgccagaggagggggtgaaggatggaatgtcctcatggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggcacggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgtcgtgtgttaagcaccaaagcccagaggtaagacggtggcagggctctctgtgcacctggattctacaggctgccatgggcc

SEQ ID NO: 402703 - DNA, 4707 bp, Homo sapiens
gggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggtgcggcggggcctggggtgcggcggggcctgcgggttggctggggttgtgaggcccggccaggccaccccttcagctcccactggctggctgtgtctcccgcaggaggcaggcagagcctgatcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcccgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggcggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggcacggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgtcgtgtgttaagcaccaaagcccagaggtaagacggtggcagggctctctgtgcacctggattctacaggctgccatgggcc

SEQ ID NO: 402704 - DNA, 4241 bp, Homo sapiens
gggctgggagtggggagcctggtgtgcacgcgtgcccaggcctgcacgtggaccgaccaggggaggggcccagagctctggctgggtcacccgcaccccgcccccatctcctccagagccaccccaggaaaagcccggctggacgaggtcatggctgccgctgcccttacaagcctgtccaccagccctctccttctgggggccccagttgcagccttcagcccagagcccggcccaggtcatgttccagtgtctgtggaagagctgcgggaaggtgctgagcacggcgtcggcgatgcagagacacatccgcctggtgcacctggggaggcaggcagagcctgatcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcccgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggcggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggcacggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgtcgtgtgttaagcaccaaagcccagaggtaagacggtggcagggctctctgtgcacctggattctacaggctgccatgggcc

SEQ ID NO: 402705 - DNA, 4685 bp, Homo sapiens
gggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgatcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccaggtgggtgaggccacgggtggcagctggggcgggtctcagggctctctggaggggagtgaagccctggctgtgtctccctgtagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcccgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggcggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggcacggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgtcgtgtgttaagcaccaaagcccagaggtaagacggtggcagggctctctgtgcacctggattctacaggctgccatgggcc

SEQ ID NO: 402706 - DNA, 4351 bp, Homo sapiens
gggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgatcagagtgatgggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcccgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggcggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggcacggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgtcgtgtgttaagcaccaaagcccagaggtaagacggtggcagggctctctgtgcacctggattctacaggctgccatgggcc

SEQ ID NO: 402707 - DNA, 1433 bp, Homo sapiens
gggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgatcagagtgatgggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttcca

SEQ ID NO: 402708 - DNA, 2617 bp, Homo sapiens
aattcaagcttctaacgatgtacggggccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcccgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggcggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggcacggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgtcgtgtgttaagcaccaaagcccagaggtaagacggtggcagggctctctgtgcacctggattctacaggctgccatgggcc

SEQ ID NO: 402709 - DNA, 2143 bp, Homo sapiens
gggttgtaaggaacggaggtgagttgttaaaagaggcatataagggagaagtgggaaaagggagaaataggaggggaaagaaaaaaaagttggtagattaaaagggaggggaaagaggggatagaagtaatgatatgaggagatggagaagggaggagggagagaaaggggaggagagaagggtggagagagaggaaagaatgatttgtatttgtttttttaggtaatattatgtatttttatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcccgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggcggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggcacggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgtcgtgtgttaagcaccaaagcccagaggtaagacggtggcagggctctctgtgcacctggattctacaggctgccatgggcc

SEQ ID NO: 402710 - DNA, 965 bp, Homo sapiens
gggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaatgatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatggggggaggcctgggcctggcccgcccctctgccagggcttcagacccctgcccagccccagtatctgaaggaaccacagtggagccaagcccgcgatgtggagaactcaggcttcaggagaccctggccctgctcctggcggctccgggtggctttcag

SEQ ID NO: 402711 - DNA, 4649 bp, Homo sapiens
cgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgatcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcccgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggcggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggcacggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgtcgtgtgttaagcaccaaagcccagaggtaagacggtggcagggctctctgtgcacctggattctacaggctgccatgggcc

SEQ ID NO: 402712 - DNA, 4602 bp, Homo sapiens
gggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgatcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcccgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggcggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggcacggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgtcgtgtgttaagcaccaaagcccagaggtaagacggtggcagggctctctgtgcacctggattctacaggctgccatgggcc

SEQ ID NO: 402713 - DNA, 1684 bp, Homo sapiens
gggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgatcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttcca

SEQ ID NO: 402714 - DNA, 1167 bp, Homo sapiens
gggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccagttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgatcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgcctttcccccactcgcacttaactcaacggctctcgggccctggggctgtttttaccatgtttgtttttgaagctcaggtgtctcacgtctgggctgcaccaggcgaagagagaaattaaagatttgaggtttttcca

SEQ ID NO: 402715 - DNA, 275 bp, Homo sapiens
cttagctttgtttacaggtttgtttaaatacacaagtgagatggtgaaactaattgtatctgtgtgtgcttcccctattttcaaatccgatattgctaaaatctgatggaacaaaatattcccactgaaagtgtttcggtggctcacgccattctcctgcctcagcctcctgagtagctgagactacaggcgcccgccaaccacgcccggctaattgttttgtatttttagtagagacagggttaaaccgtgttagccaggacggtcttgatctc

SEQ ID NO: 402716 - DNA, 388 bp, Homo sapiens
cggcctcatgactttatacttcgcggcagagccatccccattaaacagggcatgctcttaaagcgaagtgggaaatggctgaagacatggaaaaagaaatatgtcaccctgtgttccaatggcgtgctcacctattattcaagcttaggtgattatatgaagaatattcataaaaaagagattgaccttcggacatctaccatcaaagtcccaggaaagtggccatccctagccacatcggcctgcgcacccatctccagctctaaaagcaatggcctatccaaggacatgagacatcgggctgggtgactccatatgcttcagccccagtatctccagcaccaccagccccaagctcaacctgcccccctcccctcatgccaataaa

SEQ ID NO: 402717 - DNA, 557 bp, Homo sapiens
gcaccagccaggaggacctttatttcagtgttcctcccactgccaacacacccacgcccatttgcaagcagtccatgggctggtccaacctgtttacatctgagaaagggagtgacccagacaaagggaggaaagccctggagagtcacgctgacaccatcgggagcggcagagccatccccattaaacagggcatgctcttaaagcgaagtgggaaatggctgaagacatggaaaaagaaatatgtcaccctgtgttccaatggcgtgctcacctattattcaagcttaggtgattatatgaagaatattcataaaaaagagattgaccttcggacatctaccatcaaagtcccaggaaagtggccatccctagccacatcggcctgcgcacccatctccagctctaaaagcaatggcctatccaaggacatggaagctctgcatatgtcagccaattcagacatcgggctgggtgactccatatgcttcagccccagtatctccagcaccaccagccccaagctcaacctgcccccctcccctcatgccaataaa

SEQ ID NO: 402718 - DNA, 564 bp, Homo sapiens
gcaccagccaggaggacctttatttcagtgttcctcccactgccaacacacccacgcccatttgcaagcagtccatgggctggtccaacctgtttacatctgagaaagggagtgacccagacaaagggaggaaagccctggagagtcacgctgacaccatcgggagcggcagagccatccccattaaacagggcatgctcttaaagcgaagtgggaaatggctgaagacatggaaaaagaaatatgtcaccctgtgttccaatggcgtgctcacctattattcaagcttaggtgattatatgaagaatattcataaaaaagagattgaccttcggacatctaccatcaaagtcccaggaaagtggccatccctagccacatcggcctgcgcacccatctccagctctaaaagcaatggcctatccaaggacatggaagctctgcatatgtcagccaattcccacttcgctttaagagcatgccctgtgttccaatgacgtgctcaccgcgcggtgacgcattttccagctaaacaggatgtgacgagacttacctatctacaca

SEQ ID NO: 402719 - DNA, 409 bp, Homo sapiens
tctcaagtcccctttccagtttcccccgctccctttctctcctttctaatagaagagaggagtcaggtgaggagaagagaggttggtgtccaggggagatggacaaatctctttctttggatggaacctctctttcttcctcctctgttttggattgtcagttaagacccaggggcaagctgagtgtttctttcaggagaggaaaaaagctaaagttaacatgggaaaaagagcacgagaagtacatggcctccatgaaaatcagatttctttaaaaaaagaaatcgtttccttcctcaatacctagtggggctcagctcccagagacaagcggtaaatgtgcaggatgaaaagctcaaggtggaggaaggtttgctcctaagtcagagactgggaggtccccgaggca

SEQ ID NO: 402720 - DNA, 450 bp, Homo sapiens
tccatctaaacctagaaaagccttctggggaataaatcaataattctgttaggtgttttgaaactatgattttaaaattgaaatttgaaattgaaaagtgaaatttgattgttgaaccattgatttgatttaaatttttgcttgggaaatataagaggtgaaaaaacgtggggcaaagtaggtaatttaaaatttttagttaaaatctggtcactgtctagaatgggcttcttttaggacttcacataattttctttaacacagatctgtaggcccaggatttctagcttgtatgagtgccttaatattttaaactgataatcttggaccagccatagaaacccctcagatgtctcagtttaaaatataaattatttggcttttaattggaaaatattttattttagtattctttttttgagatggaatctctctctctccccaaggctg

SEQ ID NO: 402721 - DNA, 1644 bp, Homo sapiens
gggcacagtcacatacccaggatacaagacactgcagactcccgagagacataacacagaattgcaccatgccaaactacaaactcacttattttaatatgagggggagagcagaaattattcgttacatatttgcttatttggacatacagtatgaagaccacagaatagaacaagctgactggcctgaaatcaaatcaactctcccatttggaaaaatccccattttggaagttgatggacttactcttcaccagagcctagcaatagcaagatatttgaccaaaaacacagatttggctggaaacacagaaatggaacaatgtcatgttgatgctattgtggacactctggatgatttcatgtcatgttttccttgggcagagaaaaagcaagatgtgaaagagcagatgttcaatgagctgctcacgtataatgcgcctcatcttatgcaagacttggacacatatttaggggggagagaatggcttattggtaactctgtaacttgggcagacttctactgggagatttgcagtaccacacttttggtctttaagcctgacctgttagacaaccatccaaggctggtgactttacggaagaaagtccaagccattcctgccgtcgctaactggataaaacgaaggccccaaaccaaactctagctgatccatgttgccttcaagtttgtttttctcgggggcatctctctcatcagataagacagctacatcagcctgccagataatccacatgctccctccccagctccactaagattttcactttagccatattctgatttttaaaaaggaaaataaaaacaaatctttcttcagtatctttttctttcagaatagcttctcatcatttacaattacagaaaaatagtatgtaatacaggcagaccttgctttgcacaggttctaacatgcacgaattgcagtcataatggtttagcaacaccattcttcccctcccccaaaatgttttggacttcagctaccacaattacctgtaattgcataaaacacaaactttgctagtagctctccagttcacatatcgctgtgtaaataacctatgtacatcatgaccaatgaccagtcacttctatcaaagactgccagaggtcactgcacatctgttattcctgcatagatagcaaagtgtgtagttgtattgctattgcctgcttgtggcccagtgataaatccctttgacattttacaaaaatgaatcaaaagagggaactccccaacaaagatgaaagtgcagcaaaggaacaaaaactgataatcctggaatgaaattcaaactgaatataaagagttatcgagaaaagagctgactgtgggaatctgacacggctcaaaaggctctagatatgcagccagagaaacttgtaaagatgaatttactgacatgaataaagttgttgtgatgagaaaaatgtagataccccagagatcaagagaaggagaagacaagccacagacttggagaaaatacttgtaaaacatgtatctgacaaaagactattattcaaaattatatagaactcataaaactcggctgactctcttttcggactcagcccacctgcacccaggtgaaataaacagccacgttgctcacaca

SEQ ID NO: 402722 - DNA, 511 bp, Homo sapiens
ttttttactattattatattttttatttgttatcaatctagaacagagcagatgttcaatgagctgctcacgtataatgcgcctcatcttatgcaagacttggacacatatttaggggggagagaatggcttattggtaactctgtaacttgggcagacttctactgggagatttgcagtaccacacttttggtctttaagcctgacctgttagacaaccatccaaggctggtgactttacggaagaaagtccaagccattcctgccgtcgctaactggataaaacgaaggccccaaaccaaactctagctgatccatgttgccttcaagtttgtttttctcgggggcatctctctcatcagataagacagctacatcagcctgccagataatccacatgctccctccccagctccactaagattttcactttagccatattctgatttttaaaaaggaaaataaaaacaaatctttcttcataaaaaaaaaatcggtcttgttggcctta

SEQ ID NO: 402723 - DNA, 674 bp, Homo sapiens
ggcatctctagagggctcttaaaataatccctccctttttctttttccagaattgcaccatgccaaactacaaactcacttattttaatatgagggggagagcagaaattattcgttacatatttgcttatttggacatacagtatgaagaccacagaatagaacaagctgactggcctgaaatcaaatcaagtaagtagcaaaaataataaatgtaggaaaaatatgctttcagaaccttttgtttttcctcagggaaatgaactaaataaatgctgtgtgatcaagcaaatttcctattagaggtgaaaacacaaaacttacagaaagagaatataaaggtaaaccagtataaagctttagcagacaatatgagctgaaataaacatgcgacattgtttgtttgtttgtttttctattttgtcactgggatagctgaagtgcacagagtttaggtaatttttccagtttcacgaccctagcaagtagaactgagtttcaaacccaggtcagtttaataccaggctcaagctatttgcactagacaatgccaaaacaacactactatgataacaggcatattaacaatgaattgccacagcctttggaagcatgagctccttaaaagtcattgcccttataaccattctttttcttagcagagacctcttctc

SEQ ID NO: 402724 - DNA, 1266 bp, Homo sapiens
  misc_feature (1)..(1): n is a, c, g, or t
  misc_feature (11)..(12): n is a, c, g, or t
  misc_feature (24)..(24): n is a, c, g, or t
ntgcagcaaannttcaattcaggngagagcagatgttcaatgagctgctcacgtataatgcgcctcatcttatgcaagacttggacacatatttaggggggagagaatggcttattggtaactctgtaacttgggcagacttctactgggagatttgcagtaccacacttttggtctttaagcctgacctgttagacaaccatccaaggctggtgactttacggaagaaagtccaagccattcctgccgtcgctaactggataaaacgaaggccccaaaccaaactctagctgatccatgttgccttcaagtttgtttttctcgggggcatctctctcatcagataagacagctacatcagcctgccagataatccacatgctccctccccagctccactaagattttcactttagccatattctgatttttaaaaaggaaaataaaaacaaatctttcttcagtatctttttctttcagaatagcttctcatcatttacaattacagaaaaatagtatgtaatacaggcagaccttgctttgcacaggttctaacatgcacgaattgcagtcataatggtttagcaacaccattcttcccctcccccaaaatgttttggacttcagctaccacaattacctgtaattgcataaaacacaaactttgctagtagctctccagttcacatatcgctgtgtaaataacctatgtacatcatgaccaatgaccagtcacttctatcaaagactgccagaggtcactgcacatctgttattcctgcatagatagcaaagtgtgtagttgtattgctattgcctgcttgtggcccagtgataaatccctttgacattttacaaaaatgaatcaaaagagggaactccccaacaaagatgaaagtgcagcaaaggaacaaaaactgataatcctggaatgaaattcaaactgaatataaagagttatcgagaaaagagctgactgtgggaatctgacacggctcaaaaggctctagatatgcagccagagaaacttgtaaagatgaatttactgacatgaataaagttgttgtgatgagaaaaatgtagataccccagagatcaagagaaggagaagacaagccacagacttggagaaaatacttgtaaaacatgtatctgacaaaagactattattcaaaattatatagaactcataaaactcggctgactctcttttcggactcagcccacctgcacccaggtgaaataaacagccacgttgctcacaca

SEQ ID NO: 402725 - DNA, 1260 bp, Homo sapiens
acaagtggaaaattccacatgagcagatgttcaatgagctgctcacgtataatgcgcctcatcttatgcaagacttggacacatatttaggggggagagaatggcttattggtaactctgtaacttgggcagacttctactgggagatttgcagtaccacacttttggtctttaagcctgacctgttagacaaccatccaaggctggtgactttacggaagaaagtccaagccattcctgccgtcgctaactggataaaacgaaggccccaaaccaaactctagctgatccatgttgccttcaagtttgtttttctcgggggcatctctctcatcagataagacagctacatcagcctgccagataatccacatgctccctccccagctccactaagattttcactttagccatattctgatttttaaaaaggaaaataaaaacaaatctttcttcagtatctttttctttcagaatagcttctcatcatttacaattacagaaaaatagtatgtaatacaggcagaccttgctttgcacaggttctaacatgcacgaattgcagtcataatggtttagcaacaccattcttcccctcccccaaaatgttttggacttcagctaccacaattacctgtaattgcataaaacacaaactttgctagtagctctccagttcacatatcgctgtgtaaataacctatgtacatcatgaccaatgaccagtcacttctatcaaagactgccagaggtcactgcacatctgttattcctgcatagatagcaaagtgtgtagttgtattgctattgcctgcttgtggcccagtgataaatccctttgacattttacaaaaatgaatcaaaagagggaactccccaacaaagatgaaagtgcagcaaaggaacaaaaactgataatcctggaatgaaattcaaactgaatataaagagttatcgagaaaagagctgactgtgggaatctgacacggctcaaaaggctctagatatgcagccagagaaacttgtaaagatgaatttactgacatgaataaagttgttgtgatgagaaaaatgtagataccccagagatcaagagaaggagaagacaagccacagacttggagaaaatacttgtaaaacatgtatctgacaaaagactattattcaaaattatatagaactcataaaactcggctgactctcttttcggactcagcccacctgcacccaggtgaaataaacagccacgttgctcacaca

SEQ ID NO: 402726 - DNA, 430 bp, Homo sapiens
tcttttagattaagaaactaatttcaattttggaatgctgatacagctacactttctatgttcaaatgaaaagtttgtttcctttaaactaggtaacttgggcagacttctactgggagatttgcagtaccacacttttggtctttaagcctgacctgttagacaaccatccaaggctggtgactttacggaagaaagtccaagccattcctgccgtcgctaactggataaaacgaaggccccaaaccaaactctagctgatccatgttgccttcaagtttgtttttctcgggggcatctctctcatcagataagacagctacatcagcctgccagataatccacatgctccctccccagctccactaagattttcactttagccatattctgatttttaaaaaggaaaataaaaacaaatctttcttca

SEQ ID NO: 402727 - DNA, 921 bp, Homo sapiens
gaagggaccttgatgttccttttttttttttgtatccctaacatctagcaagggacccagcactcggtaaatgttcactgaatgaaatgaggggtgtagctttctgccctgagtcctgctgttcccctgtagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402728 - DNA, 359 bp, Homo sapiens
agtcgtggcgtgccacgcccgcggctcccccaccaccatacccaaatagaaagaaaacttgagcgcggacgggcttctgtttattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggcca

SEQ ID NO: 402729 - DNA, 1497 bp, Homo sapiens
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggtttgtgatggacactgtgcaaagtggctctggctgtgggggtggggtgtggggctcaggcttttccttgccatctccaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402730 - DNA, 1298 bp, Homo sapiens
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggagcccccttttgaggaggcccccccgggggggcggcgcgccctgggaccactttcttcactcttcgggccccccggcgccacacaacactctttccaattcttcccttttccccgggtcgggtccaccactggcgatttgggagaacctcctttgggaaaccccccccccggttgagcgcggcgtggcgccccctttctccccctccctctccccccccccttttggcgccccagccggctccaccctcccgcac

SEQ ID NO: 402731 - DNA, 1826 bp, Homo sapiens
caggtcccaatcctccgcttccgcgcttgcgcgccaagacggctcggatgccggcggtctctgctgaagagagaagatggcgcttgacggaccagagcaggtatggcgggtgcagtggcggcccggcaggttacggggctgggtgcggagcgagcgtgatctgagtggagagcgggccggggcaggagcgtcgggtgggtcggaggtgcctggaccagtccatgctggacgctgcctgcgaccggatctgctgtgtcagcgccgccctcggtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402732 - DNA, 1986 bp, Homo sapiens
caggtcccaatcctccgcttccgcgcttgcgcgccaagacggctcggatgccggcggtctctgctgaagagagaagatggcgcttgacggaccagagcaggtatggcgggtgcagtggcggcccggcaggttacggggctgggtgcggagcgagcgtgatctgagtggagagcgggccggggcaggagcgtcgggtgggtcggaggtgcctggaccagtccatgctggacgctgcctgcgaccggatctgctgtgtcagcgccgccctcggtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgaggtaggcggcgttcccattcttttattttagtcctccgaagtccaaactttttctactacgcaaagctacctggtgtcaagccttattcaaagtgccctgcaagtggctttaccccctcggatgtttaacctgtcgtttaagactcactctgtgtcttcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402733 - DNA, 2047 bp, Homo sapiens
gaaaaaggaccgtttatgttgttaatcaaatgtttgtgttaccagtaaggcttccagcagtaaggtatggcttccagtagtaagccttacagacaacataaacagtagtctgttagtgttacgttatactgttacggtaggctgttagtagtttaactttggacaggtccatggattttcaatttcaccctaaccccctgcgttgttcaagtgtcaactgtaatataaattggatgggggaaagccacaaaagacaattctgaattccaagtgcatttgcaggtattatgtttagtttaccatttttgaatgctttttcatgtgtttttattcgttcaccttagtagtcttgaagcagggtagctgatgctatacccatgtgccgtttggtaacagatctagatttttaaaaatagattgtcttacctttactttgcttttgattgacagcggctgggctagaactcaggtttctcacctaacaatctttccaccaggtgttgttgccttcctgcaagaaatttggtgttacatgagccagctgtaacttttctccattagattctgttactcctggaccagtattggacaagcagccttctttgatggctgctgtaaggtccagagggactcttgaaggacagggcagggtcattaggatcatactggagaatctgaaacaacatgcaggtgccctgtgcccttccctcagctcattcagacctgtgaggtcttggccaagatcctacctcctcctgtctcctgcccttgaataatggaatttgtctcttgtccgccacagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402734 - DNA, 1121 bp, Homo sapiens
atttggtggctgtcaaggaaggtcatgagcccttgtttctttaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402735 - DNA, 1983 bp, Homo sapiens
caggtcccaatcctccgcttccgcgcttgcgcgccaagacggctcggatgccggcggtctctgctgaagagagaagatggcgcttgacggaccagagcaggtatggcgggtgcagtggcggcccggcaggttacggggctgggtgcggagcgagcgtgatctgagtggagagcgggccggggcaggagcgtcgggtgggtcggaggtgcctggaccagtccatgctggacgctgcctgcgaccggatctgctgtgtcagcgccgccctcggtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgaggtaggcggcgttcccattcttttattttagtcctgggaaaatggagggttccaagggagggagggattagaacccagatcctgagcctccgaagtccaaactttttctactacgcaaagctacctggtgtcaagccttattcaaagtgccctgcaagtggctttaccccctcggatgtttaacctgtcgtttaagactcactctgtgtcttcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402736 - DNA, 1391 bp, Homo sapiens
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgataaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402737 - DNA, 1024 bp, Homo sapiens
  misc_feature (130)..(130): n is a, c, g, or t
  misc_feature (218)..(218): n is a, c, g, or t
  misc_feature (221)..(221): n is a, c, g, or t
cgatatttgtggttctggcttaggaggtctgactgataaattaactcaggcccagatctttgactacgcgtgaaatccccaacttttccctgaagtgcagcgcacgatgctggagttgctcaaccagctngacggctttgaggccaccaagaacatcaaggttatcatggctactaataggattgatatcctggactcggcactgcttcgcccagggncanttgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402738 - DNA, 1019 bp, Homo sapiens
gaagggaccttgatgttccttttttttttttgtatccctaacatctagcaagggacccagcactcggtaaatgttcactgaatgaaatgaggggtgtagctttctgccctgagtcctgctgttcccctgtagggagtgctgctgtatggacctccaggcactgggaagacactgttggcccgggctgtggctcatcatacggactgtacctttattcgtgtctctggctctgaattggtacagaaattcataggggaaggtaaccatggctagcaatgtgagaagcaagaggtaggggtagggggttagagagctaataagctaataagctccctaacaccagctcggcctccacacgggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402739 - DNA, 835 bp, Homo sapiens
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaaggttatcatggctactaataggattgatatcctggactcggcactgcttcgcccagggcgcattgacagaaaaattgaattcccaccccccaatgaggaggccggggtggctcttggagatcattctcggaagatgagctgtaccggggatcaactggaaattgttggcctgccaggccccgggtgatgagggtggcaatggttttctcgaaagggccctcccagggtgaggccgggtcgggggaactccatgtggggcggggtccgggggaa

SEQ ID NO: 402740 - DNA, 438 bp, Homo sapiens
ctcagctcattcagacctgtgaggtcttggccaagatcctacctcctcctgtctcctgcccttgaataatggaatttgtctcttgtccgccacagctgattgtgaatgataagagccaaaacctccggaggctgcaggcacagaggaacgaactaaatgctaaaggtgagtggagaaagatgggaagccgcatgtgggcagtttgtctgaggtctgtccttatctccctgcactgtgtcttcacagcagtgcttactgttttctccctgtcatcatctagtagtttcacatgcatctctttttcctgagccctattgtagcctccttaaatacatgaattttgacctttggccttcctttaataagagtgatgcttagctcatgcacgtagaattgggtcctggagactccaaaggagtagctaggtgaccactgtgt

SEQ ID NO: 402741 - DNA, 743 bp, Homo sapiens
  misc_feature (130)..(130): n is a, c, g, or t
  misc_feature (218)..(218): n is a, c, g, or t
  misc_feature (221)..(221): n is a, c, g, or t
cgatatttgtggttctggcttaggaggtctgactgataaattaactcaggcccagatctttgactacgcgtgaaatccccaacttttccctgaagtgcagcgcacgatgctggagttgctcaaccagctngacggctttgaggccaccaagaacatcaaggttatcatggctactaataggattgatatcctggactcggcactgcttcgcccagggncanttgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacaggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402742 - DNA, 1417 bp, Homo sapiens
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402743 - DNA, 1343 bp, Homo sapiens
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggcca

SEQ ID NO: 402744 - DNA, 1570 bp, Homo sapiens
  misc_feature (1355)..(1355): n is a, c, g, or t
  misc_feature (1568)..(1568): n is a, c, g, or t
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaaaaaaaaaaaanaaaaaaaaaaaaaaaaaaaaaaaaaaaaaaaaaaaaaaaaccggggggccttaaggggggggggggaaaaaggggcaagaaagggcaacggggccaaaagggtttcccggagaccacaatttgtgaaacaggggggaaaatcgggggagccccataaagaggagcggaaaaaatccagaaaccacgggttacccccgtaaaacccagaaaaangt

SEQ ID NO: 402745 - DNA, 1749 bp, Homo sapiens
  misc_feature (1503)..(1503): n is a, c, g, or t
  misc_feature (1719)..(1719): n is a, c, g, or t
  misc_feature (1740)..(1740): n is a, c, g, or t
  misc_feature (1748)..(1748): n is a, c, g, or t
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtctccagaaatgctttgggttcatctttcattgctgcaaggaacttccatgcctctaacactcatcttcaaaagactgggactgctganatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaagggtatgtccttgaacttggaacctgacaatgttggtgttgcgtgtttggaaatgatnaactaattaaggaaggagatntagtgaana

SEQ ID NO: 402746 - DNA, 2040 bp, Homo sapiens
caggtcccaatcctccgcttccgcgcttgcgcgccaagacggctcggatgccggcggtctctgctgaagagagaagatggcgcttgacggaccagagcaggtatggcgggtgcagtggcggcccggcaggttacggggctgggtgcggagcgagcgtgatctgagtggagagcgggccggggcaggagcgtcgggtgggtcggaggtgcctggaccagtccatgctggacgctgcctgcgaccggatctgctgtgtcagcgccgccctcggtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgaggtaggcggcgttcccattcttttattttagtcctgggaaaatggagggttccaagggagggagggattagaacccagatcctgagcctccgaagtccaaactttttctactacgcaaagctacctggtgtcaagccttattcaaagtgccctgcaagtggctttaccccctcggatgtttaacctgtcgtttaagactcactctgtgtcttcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402747 - DNA, 1354 bp, Homo sapiens
tactctacaggatcttggtccgctcggacgagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402748 - DNA, 1308 bp, Homo sapiens
gcgccacgcccgcgcaccactccagcccacaatattatctgtccaagattgaacgaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402749 - DNA, 1411 bp, Homo sapiens
actcatccacacacttaacaatgaacagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgaagccacgtcgacgtggcttcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402750 - DNA, 1360 bp, Homo sapiens
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402751 - DNA, 1909 bp, Homo sapiens
caggtcccaatcctccgcttccgcgcttgcgcgccaagacggctcggatgccggcggtctctgctgaagagagaagatggcgcttgacggaccagagcaggtatggcgggtgcagtggcggcccggcaggttacggggctgggtgcggagcgagcgtgatctgagtggagagcgggccggggcaggagcgtcgggtgggtcggaggtgcctggaccagtccatgctggacgctgcctgcgaccggatctgctgtgtcagcgccgccctcggtgagtcagggcaaggctgggagaggaagacgcggtagaagcggagtgagtgagggaagcgatgggcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgaggtaggcggcgttcccattcttttattttagtcctgggaaaatggagggttccaagggagggagggattagaacccagatcctgagcctccgaagtccaaactttttctactacgcaaagctacctggtgtcaagccttattcaaagtgccctgcaagtggctttaccccctcggatgtttaacctgtcgtttaagactcactctgtgtcttcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggcca

SEQ ID NO: 402752 - DNA, 1233 bp, Homo sapiens
caggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggactccagtctgttaatgagggctgtgctgttcaaggaccaggtccaggcaccaccaatagaca

SEQ ID NO: 402753 - DNA, 669 bp, Homo sapiens
  misc_feature (130)..(130): n is a, c, g, or t
  misc_feature (218)..(218): n is a, c, g, or t
  misc_feature (221)..(221): n is a, c, g, or t
cgatatttgtggttctggcttaggaggtctgactgataaattaactcaggcccagatctttgactacgcgtgaaatccccaacttttccctgaagtgcagcgcacgatgctggagttgctcaaccagctngacggctttgaggccaccaagaacatcaaggttatcatggctactaataggattgatatcctggactcggcactgcttcgcccagggncanttgctcagcccaagggagtgctgctgtatggacctccaggcactgggaagacactgttggcccgggctgtggctcatcatacggactgtacctttattcgtgtctctggctctgaattggtacagaaattcataggggaaggggcaagaatggtgagggagctgtttgtcatggcacgggaacatgctccatctatcatcttcatggacgaaatcgactccatcggctcctcgcggctggaggggggttctggaggggacaggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggcca

SEQ ID NO: 402754 - DNA, 511 bp, Homo sapiens
tttggcagtacctggggagcctgagcagcctcattagaaataagatcctcggctgggccggtggctcacacctgtaatcccagcactttgggaggcagaggcgggcagatcacctgaggtcaggagttcgagaccagcctgaccaacatggagaaacctcgtctctaccaaaaatacaaaattagccgggcgtggtggcgctcttgcctgtaatcccagctactgcggaggctgaggcaagagaatcgcttaacccgggaggcggaggttgcagtgagctgagatcacgccattgcactccagcctgggcaacaagagcgaaactccatttcaaaaaaagaaaaagaaataaggtcttcatccccaagtagggaagaggtcaaaaaggcctgcaggcatggcttatctcaccccatccaagctaaccagaatgttactacccataatggctaattgaccacatatttgtcactgcagctaaacccagacagataaaaataatttcagttgt

SEQ ID NO: 402755 - DNA, 385 bp, Homo sapiens
catggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggtctatcgctaccaggtgacgccacgcatgctgtgtgccggctaccgc

SEQ ID NO: 402756 - DNA, 367 bp, Homo sapiens
attttctccagcccacatgacacctttccagctccaaagaaaaggaaaaaggagctgaaagtccaggtcacacaactcaacaagatagttccgtgattgtaacctggacatgaaaatctcacttcaaattgttccaaaagaagagcccagacaacagggcacacactcaggaggtgcatggccgtcggctgcctcctccatgtcctgatcccaccattcagaggcagggtggtggctgggcgaagccaaaagcacacccagaatttcaccttggtctctcccaagtaactgttctcagtcccaccactttcttaatgtgaagaacaggatataaaaaatataggtgtttccccataaaatgtttaaa

SEQ ID NO: 402757 - DNA, 402 bp, Homo sapiens
  misc_feature (55)..(55): n is a, c, g, or t
aacagtcccgccgggagctaggcatgctgttatgataaaggagtcacagccagcnaacctttccagctccaaagaaaaggaaaaaggagctgaaagtccaggtcacacaactcaacaagatagttccgtgattgtaacctggacatgaaaatctcacttcaaattgttccaaaagaagagcccagacaacagggcacacactcaggaggtgcatggccgtcggctgcctcctccatgtcctgatcccaccattcagaggcagggtggtggctgggcgaagccaaaagcacacccagaatttcaccttggtctctcccaagtaactgttctcagtcccaccactttcttaatgtgaagaacaggatataaaaaatataggtgtttccccataaaatgtttaaa

SEQ ID NO: 402758 - DNA, 357 bp, Homo sapiens
aaaaaaaggtaaaaggggcagttgggtgtttcttggaaagatcactccccgttgcttttcccatctttgcttttcccatcctttgcttttcccatccttcgctcctccatccgcggccgttaccccagccctcgagcaccagaaatagaaactcggaggctggcgtcgaggctagacatggactccgcgcctggccccttccagatcccagttttctaaagtgacttcgcaccaaagtccggtataattgcggaatggggaacgtgctgctaagtttggggggagggtgttgcgggggcttgcttcgtcctctccagttatcagcccctcattcgctccatcacctaaagtgttaaa

SEQ ID NO: 402759 - DNA, 398 bp, Homo sapiens
ggatccaggcagcatgctttacctatacagccaggaaatgcagacaggaaaacatcttcactggtgtgcactgacaaagaagcttggggaagccttccataataaaaaaagatggggccgggcgcggtggctcacgcctgtaatcccagcactttgggaggccgagacggggggatcacgaggtcaggagatcgagaccatcctggctaacgcggtgaaaccccgtctctactaaaaatacaaaaaaattagtcgggcgtggtagcagacgcctgtagtcccagctactcgggaggctgagacaggagaatggtgtgaacctgggaggcggagcttgcagtgagccgagatcgctccactgcactccagcctgggcaacagagtgagactctgtctca

SEQ ID NO: 402760 - DNA, 4997 bp, Homo sapiens
gtaacttctcaatttttctgtaaactctaactactctatattagtctttaaaaaatcgcttatcttacgaatgattttgaataagcgttttgggaatgttctagagatgaatctcctccccatgtcctacgctgggtgaggaagtgtcgggtacccgggcgacctgtcctcaggtgttctaggaacgcggccccatcccttgtcagcctctgtctctgtgtggtgagaaggcgcactggctcgtgcctccgcgaaactcgcgcacacagaaaagaccaatcaaggacgggtcattcccgccccccgcgcgccttttgcgaccgcccactcgacaggttgacaacctagacagctcccccggacttgccttacttttccatctcctcccacccagctataccctcccactggcggcgcggatggcacgccgcggagccagcgagtctgcgcgagcggtccgagcatgctcaatcagcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttgttttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcctattttttgttttgtctcattcagtttactttcctgcgtagaatttttattgttatattaaaatttttattgttgtattaaagtacctgtgttacaccccttgaagtaagacagtagcatggggtaaagaaaaaatatttagtttagttgcctaatttggaagttaattaaaattaaactgtactaataacatattcaaactcatgctggatctctttcatattaatttcttatagacctgtactttattctttcaataatttttaaatgaaattaagctttgctacatggtaattaaataattactaggaagcttagctatcaaacatcgacttactaaaatttcattttagcttttatggtatatgtgcttgttttctgaatatggatacatgttacttttgatccagcatcaaaacttcactttttgttttgacttttccccccaaatctgtaaggttcaagtatacatattactgaatcctctataattggcataattcaatggtagccttaaatctcatcatgtaagcaggggaatcagaatgttattttcaagaacttaatgttcccttcagatatataaaatcctgcatacttcatttcctgtgagcttgaacagctgctgttgtgttttggggatgcttgatcatctttgcactctgccttaaagattgaaaaatcaaaactcttgttagggtatctaaacatttttgagtgtgaactggggattggaagttaatacaaaaaaatttcaaattatttctattgtaaatgaataagctagtcatggctaggataatccattttcatgtatttatgcaataaactgaattttaaggcaaaaacaacacttttctatatagtgtatgcaggacagattttagaaacttagattaaaatacaaatcccattacatttggttaaaatgaaaatctctgcttaatggaaaaaatactaatctttagcctattttgagtctataagatatatttcattttagacatgccttctaagttgttcacagatttttacctgctaaaacaatattatttccagtaaaacctctcctaacaggaaaagtggagttcaaaatatccaattggagaaaaattcagagttccttcattaaatataatttttttcatctagtatgtactatttcaagaagtgcaaaaagtaatgatagtgaatgtgataccatacttaactaaggtaatatatatccttagtttgctcaaaagagtcctggttattcctgttttctcagcttaatagtgcctcatcgtactctcaaaagtgttctaatttggaggataagttatatgatcatcctgtgtataattgtagactgtaccaagaagcaactaccttagctccactgccctttgagggatggaactggggtaagggcaggagccagttattattgccacagtgttttctaatgaaccatttggcctgtagaagaggaatagtattttttttaatagttgtatttgaatgattccagcttatcgtaaatactaaactgaatggcttttatatttttaactgctgttaaatgttattttagcatttattagttgtttattatttaattcttcaaatagtcatatgaaaacatatatttgataaaggtcaattgttagatgataatgtgccattcattatcataggaatgtccttgcccatatataaaacatgctggcatgtattttacttgttaataaagttgtatagatgtggaagtgtgaacctgtgatgcatccttttcaaaatcagtttaagattcgcatattatcatgactgtgacctcactaaactgtttatgtgacaaacctttcaagattggagatgaaaacaacacttgtgaaattaggttggggttgcaacatcttttaacttctcagttatttgtatgtcaggagacagattgtggtttaattttaataaacaaaatatcatctttttgaaaaaaaaaaat

SEQ ID NO: 402761 - DNA, 1442 bp, Homo sapiens
gtaacttctcaatttttctgtaaactctaactactctatattagtctttaaaaaatcgcttatcttacgaatgattttgaataagcgttttgggaatgttctagagatgaatctcctccccatgtcctacgctgggtgaggaagtgtcgggtacccgggcgacctgtcctcaggtgttctaggaacgcggccccatcccttgtcagcctctgtctctgtgtggtgagaaggcgcactggctcgtgcctccgcgaaactcgcgcacacagaaaagaccaatcaaggacgggtcattcccgccccccgcgcgccttttgcgaccgcccactcgacaggttgacaacctagacagctcccccggacttgccttacttttccatctcctcccacccagctataccctcccactggcggcgcggatggcacgccgcggagccagcgagtctgcgcgagcggtccgagcatgctcaatcagcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggtaagtttattcttaatgcatttagtttaacttggatatttccaaaaactgtaagatgtaaataaactgtgttgcaatttatgtggaaattatttttcttctgtaaaattctcatatt

SEQ ID NO: 402762 - DNA, 559 bp, Homo sapiens
gggttgctgtagtgtgtttgggatggtaattgtggttttgagagattatgaaaaaaggactgacgtgaaatttctaataagaaaatgtgtgattcagacatacagcatttactgtttcttgcggggagtttgaaactggtttttgtttctaaaaatactcccattttttttttgctattgcataagatgattttttctcaaataatttatatatgtgtatgctgtgtatgccattaagtgtttttatttttcctttgtgccatttttaagtgttaaagattatttgaagtaaatcattatgaaactgaagataatttatgattttcaaattcaggtgtatgaattcggttaatatatttatgttcactccatagttttctgattattttactggatatttcaatggacagtattggctttggtggatatttcttgtacttggtaagtttattcttaatgcatttagtttaacttggatatttccaaaaactgtaagatgtaaataaactgtgttgcaatttatgtggaaattatttttcttctgtaaaattctcatatt

SEQ ID NO: 402763 - DNA, 4760 bp, Homo sapiens
gtaacttctcaatttttctgtaaactctaactactctatattagtctttaaaaaatcgcttatcttacgaatgattttgaataagcgttttgggaatgttctagagatgaatctcctccccatgtcctacgctgggtgaggaagtgtcgggtacccgggcgacctgtcctcaggtgttctaggaacgcggccccatcccttgtcagcctctgtctctgtgtggtgagaaggcgcactggctcgtgcctccgcgaaactcgcgcacacagaaaagaccaatcaaggacgggtcattcccgccccccgcgcgccttttgcgaccgcccactcgacaggttgacaacctagacagctcccccggacttgccttacttttccatctcctcccacccagctataccctcccactggcggcgcggatggcacgccgcggagccagcgagtctgcgcgagcggtccgagcatgctcaatcagcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttgttttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcctattttttgttttgtctcattcagtttactttcctgcgtagaatttttattgttatattaaaatttttattgttgtattaaagtacctgtgttacaccccttgaagtaagacagtagcatggggtaaagaaaaaatatttagtttagttgcctaatttggaagttaattaaaattaaactgtactaataacatattcaaactcatgctggatctctttcatattaatttcttatagacctgtactttattctttcaataatttttaaatgaaattaagctttgctacatggtaattaaataattactaggaagcttagctatcaaacatcgacttactaaaatttcattttagcttttatggtatatgtgcttgttttctgaatatggatacatgttacttttgatccagcatcaaaacttcactttttgttttgacttttccccccaaatctgtaaggttcaagtatacatattactgaatcctctataattggcataattcaatggtagccttaaatctcatcatgtaagcaggggaatcagaatgttattttcaagaacttaatgttcccttcagatatataaaatcctgcatacttcatttcctgtgagcttgaacagctgctgttgtgttttggggatgcttgatcatctttgcactctgccttaaagattgaaaaatcaaaactcttgttagggtatctaaacatttttgagtgtgaactggggattggaagttaatacaaaaaaatttcaaattatttctattgtaaatgaataagctagtcatggctaggataatccattttcatgtatttatgcaataaactgaattttaaggcaaaaacaacacttttctatatagtgtatgcaggacagattttagaaacttagattaaaatacaaatcccattacatttggttaaaatgaaaatctctgcttaatggaaaaaatactaatctttagcctattttgagtctataagatatatttcattttagacatgccttctaagttgttcacagatttttacctgctaaaacaatattatttccagtaaaacctctcctaacaggaaaagtggagttcaaaatatccaattggagaaaaattcagagttccttcattaaatataatttttttcatctagtatgtactatttcaagaagtgcaaaaagtaatgatagtgaatgtgataccatacttaactaaggtaatatatatccttagtttgctcaaaagagtcctggttattcctgttttctcagcttaatagtgcctcatcgtactctcaaaagtgttctaatttggaggataagttatatgatcatcctgtgtataattgtagactgtaccaagaagcaactaccttagctccactgccctttgagggatggaactggggtaagggcaggagccagttattattgccacagtgttttctaatgaaccatttggcctgtagaagaggaatagtattttttttaatagttgtatttgaatgattccagcttatcgtaaatactaaactgaatggcttttatatttttaactgctgttaaatgttattttagcatttattagttgtttattatttaattcttcaaatagtcatatgaaaacatatatttgataaaggtcaattgttagatgataatgtgccattcattatcataggaatgtccttgcccatatataaaacatgctggcatgtattttacttgttaataaagttgtatagatgtgga

SEQ ID NO: 402764 - DNA, 4316 bp, Homo sapiens
atatcaatatttcatttatccgacgcattccacataccaaacgccacacccaccaagcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttgttttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcctattttttgttttgtctcattcagtttactttcctgcgtagaatttttattgttatattaaaatttttattgttgtattaaagtacctgtgttacaccccttgaagtaagacagtagcatggggtaaagaaaaaatatttagtttagttgcctaatttggaagttaattaaaattaaactgtactaataacatattcaaactcatgctggatctctttcatattaatttcttatagacctgtactttattctttcaataatttttaaatgaaattaagctttgctacatggtaattaaataattactaggaagcttagctatcaaacatcgacttactaaaatttcattttagcttttatggtatatgtgcttgttttctgaatatggatacatgttacttttgatccagcatcaaaacttcactttttgttttgacttttccccccaaatctgtaaggttcaagtatacatattactgaatcctctataattggcataattcaatggtagccttaaatctcatcatgtaagcaggggaatcagaatgttattttcaagaacttaatgttcccttcagatatataaaatcctgcatacttcatttcctgtgagcttgaacagctgctgttgtgttttggggatgcttgatcatctttgcactctgccttaaagattgaaaaatcaaaactcttgttagggtatctaaacatttttgagtgtgaactggggattggaagttaatacaaaaaaatttcaaattatttctattgtaaatgaataagctagtcatggctaggataatccattttcatgtatttatgcaataaactgaattttaaggcaaaaacaacacttttctatatagtgtatgcaggacagattttagaaacttagattaaaatacaaatcccattacatttggttaaaatgaaaatctctgcttaatggaaaaaatactaatctttagcctattttgagtctataagatatatttcattttagacatgccttctaagttgttcacagatttttacctgctaaaacaatattatttccagtaaaacctctcctaacaggaaaagtggagttcaaaatatccaattggagaaaaattcagagttccttcattaaatataatttttttcatctagtatgtactatttcaagaagtgcaaaaagtaatgatagtgaatgtgataccatacttaactaaggtaatatatatccttagtttgctcaaaagagtcctggttattcctgttttctcagcttaatagtgcctcatcgtactctcaaaagtgttctaatttggaggataagttatatgatcatcctgtgtataattgtagactgtaccaagaagcaactaccttagctccactgccctttgagggatggaactggggtaagggcaggagccagttattattgccacagtgttttctaatgaaccatttggcctgtagaagaggaatagtattttttttaatagttgtatttgaatgattccagcttatcgtaaatactaaactgaatggcttttatatttttaactgctgttaaatgttattttagcatttattagttgtttattatttaattcttcaaatagtcatatgaaaacatatatttgataaaggtcaattgttagatgataatgtgccattcattatcataggaatgtccttgcccatatataaaacatgctggcatgtattttacttgttaataaagttgtatagatgtggaagtgtgaacctgtgatgcatccttttcaaaatcagtttaagattcgcatattatcatgactgtgacctcactaaactgtttatgtgacaaacctttcaagattggagatgaaaacaacacttgtgaaattaggttggggttgcaacatcttttaacttctcagttatttgtatgtcaggagacagattgtggtttaattttaataaacaaaatatcatctttttgaaaaaaaaaaat

SEQ ID NO: 402765 - DNA, 3190 bp, Homo sapiens
  misc_feature (2998)..(3000): n is a, c, g, or t
gtaacttctcaatttttctgtaaactctaactactctatattagtctttaaaaaatcgcttatcttacgaatgattttgaataagcgttttgggaatgttctagagatgaatctcctccccatgtcctacgctgggtgaggaagtgtcgggtacccgggcgacctgtcctcaggtgttctaggaacgcggccccatcccttgtcagcctctgtctctgtgtggtgagaaggcgcactggctcgtgcctccgcgaaactcgcgcacacagaaaagaccaatcaaggacgggtcattcccgccccccgcgcgccttttgcgaccgcccactcgacaggttgacaacctagacagctcccccggacttgccttacttttccatctcctcccacccagctataccctcccactggcggcgcggatggcacgccgcggagccagcgagtctgcgcgagcggtccgagcatgctcaatcagcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttgttttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgtttnnntaaaaaaaaaaaaaaaaaaaaaaaaaaaaagggggggggctaaaaatttcccccgggggcccaattaagggtaccccgttttctgttaaaagggggccataaggggagggataaaagaagagagggggggtttaaaagcggggcgggaaaacgtccgggcctttgggaggacccttttgggggcaaatcg

SEQ ID NO: 402766 - DNA, 4872 bp, Homo sapiens
gtaacttctcaatttttctgtaaactctaactactctatattagtctttaaaaaatcgcttatcttacgaatgattttgaataagcgttttgggaatgttctagagatgaatctcctccccatgtcctacgctgggtgaggaagtgtcgggtacccgggcgacctgtcctcaggtgttctaggaacgcggccccatcccttgtcagcctctgtctctgtgtggtgagaaggcgcactggctcgtgcctccgcgaaactcgcgcacacagaaaagaccaatcaaggacgggtcattcccgccccccgcgcgccttttgcgaccgcccactcgacaggttgacaacctagacagctcccccggacttgccttacttttccatctcctcccacccagctataccctcccactggcggcgcggatggcacgccgcggagccagcgagtctgcgcgagcggtccgagcatgctcaatcagcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcattttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttgttttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcctattttttgttttgtctcattcagtttactttcctgcgtagaatttttattgttatattaaaatttttattgttgtattaaagtacctgtgttacaccccttgaagtaagacagtagcatggggtaaagaaaaaatatttagtttagttgcctaatttggaagttaattaaaattaaactgtactaataacatattcaaactcatgctggatctctttcatattaatttcttatagacctgtactttattctttcaataatttttaaatgaaattaagctttgctacatggtaattaaataattactaggaagcttagctatcaaacatcgacttactaaaatttcattttagcttttatggtatatgtgcttgttttctgaatatggatacatgttacttttgatccagcatcaaaacttcactttttgttttgacttttccccccaaatctgtaaggttcaagtatacatattactgaatcctctataattggcataattcaatggtagccttaaatctcatcatgtaagcaggggaatcagaatgttattttcaagaacttaatgttcccttcagatatataaaatcctgcatacttcatttcctgtgagcttgaacagctgctgttgtgttttggggatgcttgatcatctttgcactctgccttaaagattgaaaaatcaaaactcttgttagggtatctaaacatttttgagtgtgaactggggattggaagttaatacaaaaaaatttcaaattatttctattgtaaatgaataagctagtcatggctaggataatccattttcatgtatttatgcaataaactgaattttaaggcaaaaacaacacttttctatatagtgtatgcaggacagattttagaaacttagattaaaatacaaatcccattacatttggttaaaatgaaaatctctgcttaatggaaaaaatactaatctttagcctattttgagtctataagatatatttcattttagacatgccttctaagttgttcacagatttttacctgctaaaacaatattatttccagtaaaacctctcctaacaggaaaagtggagttcaaaatatccaattggagaaaaattcagagttccttcattaaatataatttttttcatctagtatgtactatttcaagaagtgcaaaaagtaatgatagtgaatgtgataccatacttaactaaggtaatatatatccttagtttgctcaaaagagtcctggttattcctgttttctcagcttaatagtgcctcatcgtactctcaaaagtgttctaatttggaggataagttatatgatcatcctgtgtataattgtagactgtaccaagaagcaactaccttagctccactgccctttgagggatggaactggggtaagggcaggagccagttattattgccacagtgttttctaatgaaccatttggcctgtagaagaggaatagtattttttttaatagttgtatttgaatgattccagcttatcgtaaatactaaactgaatggcttttatatttttaactgctgttaaatgttattttagcatttattagttgtttattatttaattcttcaaatagtcatatgaaaacatatatttgataaaggtcaattgttagatgataatgtgccattcattatcataggaatgtccttgcccatatataaaacatgctggcatgtattttacttgttaataaagttgtatagatgtggaagtgtgaacctgtgatgcatccttttcaaaatcagtttaagattcgcatattatcatgactgtgacctcactaaactgtttatgtgacaaacctttcaagattggagatgaaaacaacacttgtgaaattaggttggggttgcaacatcttttaacttctcagttatttgtatgtcaggagacagattgtggtttaattttaataaacaaaatatcatctttttgaaaaaaaaaaat

SEQ ID NO: 402767 - DNA, 4552 bp, Homo sapiens
agctcatggttgtaatcccagcgccttgggaggccaacacaggggtattgcttgagcccaggagttcaaggccagcctgggtaacatagcaagacttcagctctacaaaaaaaatagattgggtttcaccatattgcccaggctggtcttgaacacctgagctcgagcagtccgcttccctcagcctcccaaagtgctgggattacaggtgccagccactgtgcccagtccaacatgctgttctttctaaattccaaaattcatgttcattttgctacatcacattcaaattgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttgttttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcctattttttgttttgtctcattcagtttactttcctgcgtagaatttttattgttatattaaaatttttattgttgtattaaagtacctgtgttacaccccttgaagtaagacagtagcatggggtaaagaaaaaatatttagtttagttgcctaatttggaagttaattaaaattaaactgtactaataacatattcaaactcatgctggatctctttcatattaatttcttatagacctgtactttattctttcaataatttttaaatgaaattaagctttgctacatggtaattaaataattactaggaagcttagctatcaaacatcgacttactaaaatttcattttagcttttatggtatatgtgcttgttttctgaatatggatacatgttacttttgatccagcatcaaaacttcactttttgttttgacttttccccccaaatctgtaaggttcaagtatacatattactgaatcctctataattggcataattcaatggtagccttaaatctcatcatgtaagcaggggaatcagaatgttattttcaagaacttaatgttcccttcagatatataaaatcctgcatacttcatttcctgtgagcttgaacagctgctgttgtgttttggggatgcttgatcatctttgcactctgccttaaagattgaaaaatcaaaactcttgttagggtatctaaacatttttgagtgtgaactggggattggaagttaatacaaaaaaatttcaaattatttctattgtaaatgaataagctagtcatggctaggataatccattttcatgtatttatgcaataaactgaattttaaggcaaaaacaacacttttctatatagtgtatgcaggacagattttagaaacttagattaaaatacaaatcccattacatttggttaaaatgaaaatctctgcttaatggaaaaaatactaatctttagcctattttgagtctataagatatatttcattttagacatgccttctaagttgttcacagatttttacctgctaaaacaatattatttccagtaaaacctctcctaacaggaaaagtggagttcaaaatatccaattggagaaaaattcagagttccttcattaaatataatttttttcatctagtatgtactatttcaagaagtgcaaaaagtaatgatagtgaatgtgataccatacttaactaaggtaatatatatccttagtttgctcaaaagagtcctggttattcctgttttctcagcttaatagtgcctcatcgtactctcaaaagtgttctaatttggaggataagttatatgatcatcctgtgtataattgtagactgtaccaagaagcaactaccttagctccactgccctttgagggatggaactggggtaagggcaggagccagttattattgccacagtgttttctaatgaaccatttggcctgtagaagaggaatagtattttttttaatagttgtatttgaatgattccagcttatcgtaaatactaaactgaatggcttttatatttttaactgctgttaaatgttattttagcatttattagttgtttattatttaattcttcaaatagtcatatgaaaacatatatttgataaaggtcaattgttagatgataatgtgccattcattatcataggaatgtccttgcccatatataaaacatgctggcatgtattttacttgttaataaagttgtatagatgtggaagtgtgaacctgtgatgcatccttttcaaaatcagtttaagattcgcatattatcatgactgtgacctcactaaactgtttatgtgacaaacctttcaagattggagatgaaaacaacacttgtgaaattaggttggggttgcaacatcttttaacttctcagttatttgtatgtcaggagacagattgtggtttaattttaataaacaaaatatcatctttttgaaaaaaaaaaat

SEQ ID NO: 402768 - DNA, 403 bp, Homo sapiens
cctttgcccttccataagtattttgaacatgtttgtacatatccatcacattgtactatacgtgttgaaatgtgtttcaccataatatctatcgcagtgactgggcacattgggaatctctagtaactgatgtttcaatagcttcttgctctcaagaagctgtgttgattaacagtgactctttgtttccataacacatctatgaaacgctgccgcatatcaagttctaaagatatagattgtgcagctggggaaaaatcttaaaaagcagagggatcagtcccatagaagtaaaacaactgcaacatggagaaacctcatctctacaaaaaatacaaaaatttactagttgtagtggtgcacgcctgtgagtcccagctactcaggagactgaggcaggagg

SEQ ID NO: 402769 - DNA, 401 bp, Homo sapiens
taattgagatagtctcgtcctgatggccagactggagtacagtggtgtgatctcggctcactgcatcctccgcctcctaggttcaagcgattcttccacctcagcctcccaagtagctgggatcacaggtatatgtcaccatgcctggctaatttttgtattttttgtagagatggggtttcgccatgttggccaggctggtcttgaactcctgacctacagtgatccgcctgccttggtctcccaaagttctgggattacaggcgtgagccactgaacctggccaaaagtggtattttctattgcatttgaggtaacagaaattgatgggcttgttattgcatttggcgtggctggttttttttttccatgttgtctttctccactgactgtcaaaaaaa
